United States Patent 11,851,659 (COMPOSITIONS AND METHODS FOR IMMUNOONCOLOGY) - sequence listing, part 2

SEQ ID NO: 8678 - RNA, 20 nt, Artificial Sequence
  source: /note="Description of Artificial Sequence: Synthetic oligonucleotide"
uuugcaaaauacagaauucu

SEQ ID NO: 8679 - RNA, 20 nt, Artificial Sequence
  source: /note="Description of Artificial Sequence: Synthetic oligonucleotide"
caaaauacagaauucuuggu

SEQ ID NO: 8680 - RNA, 20 nt, Artificial Sequence
  source: /note="Description of Artificial Sequence: Synthetic oligonucleotide"
gguuggcagucuuuuucuug

SEQ ID NO: 8681 - RNA, 20 nt, Artificial Sequence
  source: /note="Description of Artificial Sequence: Synthetic oligonucleotide"
uaugucauucuacugccuuc

SEQ ID NO: 8682 - RNA, 20 nt, Artificial Sequence
  source: /note="Description of Artificial Sequence: Synthetic oligonucleotide"
agaucagcuauuaaucuuau

SEQ ID NO: 8683 - RNA, 20 nt, Artificial Sequence
  source: /note="Description of Artificial Sequence: Synthetic oligonucleotide"
gaucagcuauuaaucuuauu

SEQ ID NO: 8684 - RNA, 20 nt, Artificial Sequence
  source: /note="Description of Artificial Sequence: Synthetic oligonucleotide"
uuuucaugauuuucuugugu

SEQ ID NO: 8685 - RNA, 20 nt, Artificial Sequence
  source: /note="Description of Artificial Sequence: Synthetic oligonucleotide"
uguguuggcuuucagcaguu

SEQ ID NO: 8686 - RNA, 20 nt, Artificial Sequence
  source: /note="Description of Artificial Sequence: Synthetic oligonucleotide"
uuuauauguaugcauaucuu

SEQ ID NO: 8687 - RNA, 20 nt, Artificial Sequence
  source: /note="Description of Artificial Sequence: Synthetic oligonucleotide"
uuauauguaugcauaucuuu

SEQ ID NO: 8688 - RNA, 20 nt, Artificial Sequence
  source: /note="Description of Artificial Sequence: Synthetic oligonucleotide"
aucuuuggguuuauguuaca

SEQ ID NO: 8689 - RNA, 20 nt, Artificial Sequence
  source: /note="Description of Artificial Sequence: Synthetic oligonucleotide"
auggaguuaguugagcuucu

SEQ ID NO: 8690 - RNA, 20 nt, Artificial Sequence
  source: /note="Description of Artificial Sequence: Synthetic oligonucleotide"
caucaaauuugagaaguuuu

SEQ ID NO: 8691 - RNA, 20 nt, Artificial Sequence
  source: /note="Description of Artificial Sequence: Synthetic oligonucleotide"
uuauucuucauccucuacuu

SEQ ID NO: 8692 - RNA, 20 nt, Artificial Sequence
  source: /note="Description of Artificial Sequence: Synthetic oligonucleotide"
uauucuucauccucuacuuu

SEQ ID NO: 8693 - RNA, 20 nt, Artificial Sequence
  source: /note="Description of Artificial Sequence: Synthetic oligonucleotide"
auucuucauccucuacuuug

SEQ ID NO: 8694 - RNA, 20 nt, Artificial Sequence
  source: /note="Description of Artificial Sequence: Synthetic oligonucleotide"
gaccugcauuaugucuaugu

SEQ ID NO: 8695 - RNA, 20 nt, Artificial Sequence
  source: /note="Description of Artificial Sequence: Synthetic oligonucleotide"
gucuauguugguaugcuuua

SEQ ID NO: 8696 - RNA, 20 nt, Artificial Sequence
  source: /note="Description of Artificial Sequence: Synthetic oligonucleotide"
uggucuuccacagaucucug

SEQ ID NO: 8697 - RNA, 20 nt, Artificial Sequence
  source: /note="Description of Artificial Sequence: Synthetic oligonucleotide"
uacaguuuucuuucauuauu

SEQ ID NO: 8698 - RNA, 20 nt, Artificial Sequence
  source: /note="Description of Artificial Sequence: Synthetic oligonucleotide"
acaguuuucuuucauuauuu

SEQ ID NO: 8699 - RNA, 20 nt, Artificial Sequence
  source: /note="Description of Artificial Sequence: Synthetic oligonucleotide"
gacuuaaagucuuuguccag

SEQ ID NO: 8700 - RNA, 20 nt, Artificial Sequence
  source: /note="Description of Artificial Sequence: Synthetic oligonucleotide"
uuguccaguggccuaacauc

SEQ ID NO: 8701 - RNA, 20 nt, Artificial Sequence
  source: /note="Description of Artificial Sequence: Synthetic oligonucleotide"
ccuaacaucuggacuuuuuc

SEQ ID NO: 8702 - RNA, 20 nt, Artificial Sequence
  source: /note="Description of Artificial Sequence: Synthetic oligonucleotide"
gccucuauugacuacuuuau

SEQ ID NO: 8703 - RNA, 20 nt, Artificial Sequence
  source: /note="Description of Artificial Sequence: Synthetic oligonucleotide"
ccucuauugacuacuuuaua

SEQ ID NO: 8704 - RNA, 20 nt, Artificial Sequence
  source: /note="Description of Artificial Sequence: Synthetic oligonucleotide"
cucuauugacuacuuuauag

SEQ ID NO: 8705 - RNA, 20 nt, Artificial Sequence
  source: /note="Description of Artificial Sequence: Synthetic oligonucleotide"
gacauuuuaaacuaauguaa

SEQ ID NO: 8706 - RNA, 20 nt, Artificial Sequence
  source: /note="Description of Artificial Sequence: Synthetic oligonucleotide"
aauguaauggcugagagcag

SEQ ID NO: 8707 - RNA, 20 nt, Artificial Sequence
  source: /note="Description of Artificial Sequence: Synthetic oligonucleotide"
uguaaucccagcacguugag

SEQ ID NO: 8708 - RNA, 20 nt, Artificial Sequence
  source: /note="Description of Artificial Sequence: Synthetic oligonucleotide"
gcacguugagaggccaaagc

SEQ ID NO: 8709 - RNA, 20 nt, Artificial Sequence
  source: /note="Description of Artificial Sequence: Synthetic oligonucleotide"
caggagcaucacuuaagccc

SEQ ID NO: 8710 - RNA, 20 nt, Artificial Sequence
  source: /note="Description of Artificial Sequence: Synthetic oligonucleotide"
ccaggaguucaagacuagcc

SEQ ID NO: 8711 - RNA, 20 nt, Artificial Sequence
  source: /note="Description of Artificial Sequence: Synthetic oligonucleotide"
caggaguucaagacuagccu

SEQ ID NO: 8712 - RNA, 20 nt, Artificial Sequence
  source: /note="Description of Artificial Sequence: Synthetic oligonucleotide"
auaaauaaaauaauauaauc

SEQ ID NO: 8713 - RNA, 20 nt, Artificial Sequence
  source: /note="Description of Artificial Sequence: Synthetic oligonucleotide"
ccagaauauguuacuguuuc

SEQ ID NO: 8714 - RNA, 20 nt, Artificial Sequence
  source: /note="Description of Artificial Sequence: Synthetic oligonucleotide"
gaauauguuacuguuucugg

SEQ ID NO: 8715 - RNA, 20 nt, Artificial Sequence
  source: /note="Description of Artificial Sequence: Synthetic oligonucleotide"
uagccaucgaagucuuugcu

SEQ ID NO: 8716 - RNA, 20 nt, Artificial Sequence
  source: /note="Description of Artificial Sequence: Synthetic oligonucleotide"
ucuuugcuugguuaacuuag

SEQ ID NO: 8717 - RNA, 20 nt, Artificial Sequence
  source: /note="Description of Artificial Sequence: Synthetic oligonucleotide"
guuaacuuagaggucagcua

SEQ ID NO: 8718 - RNA, 20 nt, Artificial Sequence
  source: /note="Description of Artificial Sequence: Synthetic oligonucleotide"
aggauuagacagaauuccuu

SEQ ID NO: 8719 - RNA, 20 nt, Artificial Sequence
  source: /note="Description of Artificial Sequence: Synthetic oligonucleotide"
aauaagucagucuuugacaa

SEQ ID NO: 8720 - RNA, 20 nt, Artificial Sequence
  source: /note="Description of Artificial Sequence: Synthetic oligonucleotide"
auaagucagucuuugacaaa

SEQ ID NO: 8721 - RNA, 20 nt, Artificial Sequence
  source: /note="Description of Artificial Sequence: Synthetic oligonucleotide"
uaagucagucuuugacaaag

SEQ ID NO: 8722 - RNA, 20 nt, Artificial Sequence
  source: /note="Description of Artificial Sequence: Synthetic oligonucleotide"
aaaggggucuguaugugugu

SEQ ID NO: 8723 - RNA, 20 nt, Artificial Sequence
  source: /note="Description of Artificial Sequence: Synthetic oligonucleotide"
aaggggucuguauguguguu

SEQ ID NO: 8724 - RNA, 20 nt, Artificial Sequence
  source: /note="Description of Artificial Sequence: Synthetic oligonucleotide"
aggggucuguauguguguug

SEQ ID NO: 8725 - RNA, 20 nt, Artificial Sequence
  source: /note="Description of Artificial Sequence: Synthetic oligonucleotide"
caugcauucaacacucagcc

SEQ ID NO: 8726 - RNA, 20 nt, Artificial Sequence
  source: /note="Description of Artificial Sequence: Synthetic oligonucleotide"
agccaggcuauuugcagcuc

SEQ ID NO: 8727 - RNA, 20 nt, Artificial Sequence
  source: /note="Description of Artificial Sequence: Synthetic oligonucleotide"
ccugcuugugcagagucuca

SEQ ID NO: 8728 - RNA, 20 nt, Artificial Sequence
  source: /note="Description of Artificial Sequence: Synthetic oligonucleotide"
agagucucaagguuagacug

SEQ ID NO: 8729 - RNA, 20 nt, Artificial Sequence
  source: /note="Description of Artificial Sequence: Synthetic oligonucleotide"
uuagacuguggugagaguuu

SEQ ID NO: 8730 - RNA, 20 nt, Artificial Sequence
  source: /note="Description of Artificial Sequence: Synthetic oligonucleotide"
uagacuguggugagaguuua

SEQ ID NO: 8731 - RNA, 20 nt, Artificial Sequence
  source: /note="Description of Artificial Sequence: Synthetic oligonucleotide"
ugagaguuuagggcuuucug

SEQ ID NO: 8732 - RNA, 20 nt, Artificial Sequence
  source: /note="Description of Artificial Sequence: Synthetic oligonucleotide"
gggcuuucugaggucuuuug

SEQ ID NO: 8733 - RNA, 20 nt, Artificial Sequence
  source: /note="Description of Artificial Sequence: Synthetic oligonucleotide"
ggcuuucugaggucuuuugu

SEQ ID NO: 8734 - RNA, 20 nt, Artificial Sequence
  source: /note="Description of Artificial Sequence: Synthetic oligonucleotide"
gugggcccuacaguugcaug

SEQ ID NO: 8735 - RNA, 20 nt, Artificial Sequence
  source: /note="Description of Artificial Sequence: Synthetic oligonucleotide"
auguggcuuucuaaauuccc

SEQ ID NO: 8736 - RNA, 20 nt, Artificial Sequence
  source: /note="Description of Artificial Sequence: Synthetic oligonucleotide"
uauauuuucaaagccuccug

SEQ ID NO: 8737 - RNA, 20 nt, Artificial Sequence
  source: /note="Description of Artificial Sequence: Synthetic oligonucleotide"
uguggaucaucucauuuccc

SEQ ID NO: 8738 - RNA, 20 nt, Artificial Sequence
  source: /note="Description of Artificial Sequence: Synthetic oligonucleotide"
uuauuugacaaaugccucug

SEQ ID NO: 8739 - RNA, 20 nt, Artificial Sequence
  source: /note="Description of Artificial Sequence: Synthetic oligonucleotide"
gacaaaugccucuguggaaa

SEQ ID NO: 8740 - RNA, 20 nt, Artificial Sequence
  source: /note="Description of Artificial Sequence: Synthetic oligonucleotide"
aaaugccucuguggaaaagg

SEQ ID NO: 8741 - RNA, 20 nt, Artificial Sequence
  source: /note="Description of Artificial Sequence: Synthetic oligonucleotide"
uggaaaaggugguucacacu

SEQ ID NO: 8742 - RNA, 20 nt, Artificial Sequence
  source: /note="Description of Artificial Sequence: Synthetic oligonucleotide"
aguaaagauaaccuuacuag

SEQ ID NO: 8743 - RNA, 20 nt, Artificial Sequence
  source: /note="Description of Artificial Sequence: Synthetic oligonucleotide"
guaaagauaaccuuacuagu

SEQ ID NO: 8744 - RNA, 20 nt, Artificial Sequence
  source: /note="Description of Artificial Sequence: Synthetic oligonucleotide"
ccuuacuagugggaucuucc

SEQ ID NO: 8745 - RNA, 20 nt, Artificial Sequence
  source: /note="Description of Artificial Sequence: Synthetic oligonucleotide"
cuuccaggaaacuaccaaac

SEQ ID NO: 8746 - RNA, 20 nt, Artificial Sequence
  source: /note="Description of Artificial Sequence: Synthetic oligonucleotide"
caaacaggucaaauaaugua

SEQ ID NO: 8747 - RNA, 20 nt, Artificial Sequence
  source: /note="Description of Artificial Sequence: Synthetic oligonucleotide"
uaauguaaggucucugugaa

SEQ ID NO: 8748 - RNA, 20 nt, Artificial Sequence
  source: /note="Description of Artificial Sequence: Synthetic oligonucleotide"
aauguaaggucucugugaau

SEQ ID NO: 8749 - RNA, 20 nt, Artificial Sequence
  source: /note="Description of Artificial Sequence: Synthetic oligonucleotide"
uagaguauauccaaccaauc

SEQ ID NO: 8750 - RNA, 20 nt, Artificial Sequence
  source: /note="Description of Artificial Sequence: Synthetic oligonucleotide"
accaaucuggccuccucuag

SEQ ID NO: 8751 - RNA, 20 nt, Artificial Sequence
  source: /note="Description of Artificial Sequence: Synthetic oligonucleotide"
ggccuccucuaguggcagcc

SEQ ID NO: 8752 - RNA, 20 nt, Artificial Sequence
  source: /note="Description of Artificial Sequence: Synthetic oligonucleotide"
gcugcuuuucauaauaaaug

SEQ ID NO: 8753 - RNA, 20 nt, Artificial Sequence
  source: /note="Description of Artificial Sequence: Synthetic oligonucleotide"
cugcuuuucauaauaaaugu

SEQ ID NO: 8754 - RNA, 20 nt, Artificial Sequence
  source: /note="Description of Artificial Sequence: Synthetic oligonucleotide"
ugugggcuguuuugauuuga

SEQ ID NO: 8755 - RNA, 20 nt, Artificial Sequence
  source: /note="Description of Artificial Sequence: Synthetic oligonucleotide"
ugaaggcuaccauagagcug

SEQ ID NO: 8756 - RNA, 20 nt, Artificial Sequence
  source: /note="Description of Artificial Sequence: Synthetic oligonucleotide"
gaaggcuaccauagagcugu

SEQ ID NO: 8757 - RNA, 20 nt, Artificial Sequence
  source: /note="Description of Artificial Sequence: Synthetic oligonucleotide"
aaggcuaccauagagcugug

SEQ ID NO: 8758 - RNA, 20 nt, Artificial Sequence
  source: /note="Description of Artificial Sequence: Synthetic oligonucleotide"
caguacuuuuauugcuuuua

SEQ ID NO: 8759 - RNA, 20 nt, Artificial Sequence
  source: /note="Description of Artificial Sequence: Synthetic oligonucleotide"
uacuuuuauugcuuuuaugg

SEQ ID NO: 8760 - RNA, 20 nt, Artificial Sequence
  source: /note="Description of Artificial Sequence: Synthetic oligonucleotide"
uuccuuuugcauuuauuagc

SEQ ID NO: 8761 - RNA, 20 nt, Artificial Sequence
  source: /note="Description of Artificial Sequence: Synthetic oligonucleotide"
uauuagcuggaauacuuuac

SEQ ID NO: 8762 - RNA, 20 nt, Artificial Sequence
  source: /note="Description of Artificial Sequence: Synthetic oligonucleotide"
agaaugauagaauaaaugca

SEQ ID NO: 8763 - RNA, 20 nt, Artificial Sequence
  source: /note="Description of Artificial Sequence: Synthetic oligonucleotide"
ucaaauuucagagauuuuga

SEQ ID NO: 8764 - RNA, 20 nt, Artificial Sequence
  source: /note="Description of Artificial Sequence: Synthetic oligonucleotide"
caaauuucagagauuuugau

SEQ ID NO: 8765 - RNA, 20 nt, Artificial Sequence
  source: /note="Description of Artificial Sequence: Synthetic oligonucleotide"
ucuagaugugcucccugcua

SEQ ID NO: 8766 - RNA, 20 nt, Artificial Sequence
  source: /note="Description of Artificial Sequence: Synthetic oligonucleotide"
agaugugcucccugcuaugg

SEQ ID NO: 8767 - RNA, 20 nt, Artificial Sequence
  source: /note="Description of Artificial Sequence: Synthetic oligonucleotide"
auggaggugucauuacuuuu

SEQ ID NO: 8768 - RNA, 20 nt, Artificial Sequence
  source: /note="Description of Artificial Sequence: Synthetic oligonucleotide"
uuacuuuuaggcuuuuuuaa

SEQ ID NO: 8769 - RNA, 20 nt, Artificial Sequence
  source: /note="Description of Artificial Sequence: Synthetic oligonucleotide"
uacuuuuaggcuuuuuuaau

SEQ ID NO: 8770 - RNA, 20 nt, Artificial Sequence
  source: /note="Description of Artificial Sequence: Synthetic oligonucleotide"
cucuuguacacugaaauucu

SEQ ID NO: 8771 - RNA, 20 nt, Artificial Sequence
  source: /note="Description of Artificial Sequence: Synthetic oligonucleotide"
ucauuagaauguaucaaacu

SEQ ID NO: 8772 - RNA, 20 nt, Artificial Sequence
  source: /note="Description of Artificial Sequence: Synthetic oligonucleotide"
cauuagaauguaucaaacua

SEQ ID NO: 8773 - RNA, 20 nt, Artificial Sequence
  source: /note="Description of Artificial Sequence: Synthetic oligonucleotide"
cuauauuuuagccagaaacu

SEQ ID NO: 8774 - RNA, 20 nt, Artificial Sequence
  source: /note="Description of Artificial Sequence: Synthetic oligonucleotide"
agcacucaaaugcccaucaa

SEQ ID NO: 8775 - RNA, 20 nt, Artificial Sequence
  source: /note="Description of Artificial Sequence: Synthetic oligonucleotide"
uucaucacauuuuuauaaga

SEQ ID NO: 8776 - RNA, 20 nt, Artificial Sequence
  source: /note="Description of Artificial Sequence: Synthetic oligonucleotide"
cauuuuuauaagauggaaua

SEQ ID NO: 8777 - RNA, 20 nt, Artificial Sequence
  source: /note="Description of Artificial Sequence: Synthetic oligonucleotide"
uacaacuacaugcagugauu

SEQ ID NO: 8778 - RNA, 20 nt, Artificial Sequence
  source: /note="Description of Artificial Sequence: Synthetic oligonucleotide"
acuacaugcagugauuugga

SEQ ID NO: 8779 - RNA, 20 nt, Artificial Sequence
  source: /note="Description of Artificial Sequence: Synthetic oligonucleotide"
gauggauaucccaaacauaa

SEQ ID NO: 8780 - RNA, 20 nt, Artificial Sequence
  source: /note="Description of Artificial Sequence: Synthetic oligonucleotide"
uauauaucaaguauaaaagu

SEQ ID NO: 8781 - RNA, 20 nt, Artificial Sequence
  source: /note="Description of Artificial Sequence: Synthetic oligonucleotide"
uaggcaaaacaagcuacuga

SEQ ID NO: 8782 - RNA, 20 nt, Artificial Sequence
  source: /note="Description of Artificial Sequence: Synthetic oligonucleotide"
gcaaaacaagcuacugaugg

SEQ ID NO: 8783 - RNA, 20 nt, Artificial Sequence
  source: /note="Description of Artificial Sequence: Synthetic oligonucleotide"
caccuauaguuccagcuauu

SEQ ID NO: 8784 - RNA, 20 nt, Artificial Sequence
  source: /note="Description of Artificial Sequence: Synthetic oligonucleotide"
accuauaguuccagcuauuu

SEQ ID NO: 8785 - RNA, 20 nt, Artificial Sequence
  source: /note="Description of Artificial Sequence: Synthetic oligonucleotide"
uauaguuccagcuauuuggg

SEQ ID NO: 8786 - RNA, 20 nt, Artificial Sequence
  source: /note="Description of Artificial Sequence: Synthetic oligonucleotide"
uccagcuauuugggaggcug

SEQ ID NO: 8787 - RNA, 20 nt, Artificial Sequence
  source: /note="Description of Artificial Sequence: Synthetic oligonucleotide"
agcuauuugggaggcugagg

SEQ ID NO: 8788 - RNA, 20 nt, Artificial Sequence
  source: /note="Description of Artificial Sequence: Synthetic oligonucleotide"
gcuauuugggaggcugaggc

SEQ ID NO: 8789 - RNA, 20 nt, Artificial Sequence
  source: /note="Description of Artificial Sequence: Synthetic oligonucleotide"
ucacuugagcccagaaguuc

SEQ ID NO: 8790 - RNA, 20 nt, Artificial Sequence
  source: /note="Description of Artificial Sequence: Synthetic oligonucleotide"
agcauuauuaacauaaaaau

SEQ ID NO: 8791 - RNA, 20 nt, Artificial Sequence
  source: /note="Description of Artificial Sequence: Synthetic oligonucleotide"
uucuuagagaaguuacuguu

SEQ ID NO: 8792 - RNA, 20 nt, Artificial Sequence
  source: /note="Description of Artificial Sequence: Synthetic oligonucleotide"
ucuuagagaaguuacuguua

SEQ ID NO: 8793 - RNA, 20 nt, Artificial Sequence
  source: /note="Description of Artificial Sequence: Synthetic oligonucleotide"
acagacagugagugacugaa

SEQ ID NO: 8794 - RNA, 20 nt, Artificial Sequence
  source: /note="Description of Artificial Sequence: Synthetic oligonucleotide"
agugacugaaaggcaaaaug

SEQ ID NO: 8795 - RNA, 20 nt, Artificial Sequence
  source: /note="Description of Artificial Sequence: Synthetic oligonucleotide"
gugacugaaaggcaaaauga

SEQ ID NO: 8796 - RNA, 20 nt, Artificial Sequence
  source: /note="Description of Artificial Sequence: Synthetic oligonucleotide"
ugacugaaaggcaaaaugag

SEQ ID NO: 8797 - RNA, 20 nt, Artificial Sequence
  source: /note="Description of Artificial Sequence: Synthetic oligonucleotide"
gcaaaaugaggggaaauucc

SEQ ID NO: 8798 - RNA, 20 nt, Artificial Sequence
  source: /note="Description of Artificial Sequence: Synthetic oligonucleotide"
caaaaugaggggaaauucca

SEQ ID NO: 8799 - RNA, 20 nt, Artificial Sequence
  source: /note="Description of Artificial Sequence: Synthetic oligonucleotide"
aaaaugaggggaaauuccag

SEQ ID NO: 8800 - RNA, 20 nt, Artificial Sequence
  source: /note="Description of Artificial Sequence: Synthetic oligonucleotide"
aaauauuuuguuucuuagug

SEQ ID NO: 8801 - RNA, 20 nt, Artificial Sequence
  source: /note="Description of Artificial Sequence: Synthetic oligonucleotide"
aauauuuuguuucuuagugu

SEQ ID NO: 8802 - RNA, 20 nt, Artificial Sequence
  source: /note="Description of Artificial Sequence: Synthetic oligonucleotide"
uaguguggguucuacuuaac

SEQ ID NO: 8803 - RNA, 20 nt, Artificial Sequence
  source: /note="Description of Artificial Sequence: Synthetic oligonucleotide"
aguguggguucuacuuaacu

SEQ ID NO: 8804 - RNA, 20 nt, Artificial Sequence
  source: /note="Description of Artificial Sequence: Synthetic oligonucleotide"
aauugaaauaguucugugug

SEQ ID NO: 8805 - RNA, 20 nt, Artificial Sequence
  source: /note="Description of Artificial Sequence: Synthetic oligonucleotide"
gcuauccauagcaaugaauu

SEQ ID NO: 8806 - RNA, 20 nt, Artificial Sequence
  source: /note="Description of Artificial Sequence: Synthetic oligonucleotide"
cuucacuuacucuucauuca

SEQ ID NO: 8807 - RNA, 20 nt, Artificial Sequence
  source: /note="Description of Artificial Sequence: Synthetic oligonucleotide"
gcaaagaggggagaggcccu

SEQ ID NO: 8808 - RNA, 20 nt, Artificial Sequence
  source: /note="Description of Artificial Sequence: Synthetic oligonucleotide"
cgcaaagaggggagaggccc

SEQ ID NO: 8809 - RNA, 20 nt, Artificial Sequence
  source: /note="Description of Artificial Sequence: Synthetic oligonucleotide"
aguggccgcaaagaggggag

SEQ ID NO: 8810 - RNA, 20 nt, Artificial Sequence
  source: /note="Description of Artificial Sequence: Synthetic oligonucleotide"
cuaucaguggccgcaaagag

SEQ ID NO: 8811 - RNA, 20 nt, Artificial Sequence
  source: /note="Description of Artificial Sequence: Synthetic oligonucleotide"
ccuaucaguggccgcaaaga

SEQ ID NO: 8812 - RNA, 20 nt, Artificial Sequence
  source: /note="Description of Artificial Sequence: Synthetic oligonucleotide"
uccuaucaguggccgcaaag

SEQ ID NO: 8813 - RNA, 20 nt, Artificial Sequence
  source: /note="Description of Artificial Sequence: Synthetic oligonucleotide"
agauugggcuuuccuaucag

SEQ ID NO: 8814 - RNA, 20 nt, Artificial Sequence
  source: /note="Description of Artificial Sequence: Synthetic oligonucleotide"
cuuccuuucaaccaaagauu

SEQ ID NO: 8815 - RNA, 20 nt, Artificial Sequence
  source: /note="Description of Artificial Sequence: Synthetic oligonucleotide"
ucuuccuuucaaccaaagau

SEQ ID NO: 8816 - RNA, 20 nt, Artificial Sequence
  source: /note="Description of Artificial Sequence: Synthetic oligonucleotide"
uuaucgcaugacugccaaac

SEQ ID NO: 8817 - RNA, 20 nt, Artificial Sequence
  source: /note="Description of Artificial Sequence: Synthetic oligonucleotide"
cucugacugcuccuaauuaa

SEQ ID NO: 8818 - RNA, 20 nt, Artificial Sequence
  source: /note="Description of Artificial Sequence: Synthetic oligonucleotide"
augguauaacugaggccaug

SEQ ID NO: 8819 - RNA, 20 nt, Artificial Sequence
  source: /note="Description of Artificial Sequence: Synthetic oligonucleotide"
ucaaguuuaugguauaacug

SEQ ID NO: 8820 - RNA, 20 nt, Artificial Sequence
  source: /note="Description of Artificial Sequence: Synthetic oligonucleotide"
cauaaacaauuucaaguuua

SEQ ID NO: 8821 - RNA, 20 nt, Artificial Sequence
  source: /note="Description of Artificial Sequence: Synthetic oligonucleotide"
aauauaguggccaggcacac

SEQ ID NO: 8822 - RNA, 20 nt, Artificial Sequence
  source: /note="Description of Artificial Sequence: Synthetic oligonucleotide"
uacauacuaauauaguggcc

SEQ ID NO: 8823 - RNA, 20 nt, Artificial Sequence
  source: /note="Description of Artificial Sequence: Synthetic oligonucleotide"
gucaauacauacuaauauag

SEQ ID NO: 8824 - RNA, 20 nt, Artificial Sequence
  source: /note="Description of Artificial Sequence: Synthetic oligonucleotide"
cagauacugcaacauggaag

SEQ ID NO: 8825 - RNA, 20 nt, Artificial Sequence
  source: /note="Description of Artificial Sequence: Synthetic oligonucleotide"
cuguuucagauacugcaaca

SEQ ID NO: 8826 - RNA, 20 nt, Artificial Sequence
  source: /note="Description of Artificial Sequence: Synthetic oligonucleotide"
auauggaagguauuugaccu

SEQ ID NO: 8827 - RNA, 20 nt, Artificial Sequence
  source: /note="Description of Artificial Sequence: Synthetic oligonucleotide"
cauauggaagguauuugacc

SEQ ID NO: 8828 - RNA, 20 nt, Artificial Sequence
  source: /note="Description of Artificial Sequence: Synthetic oligonucleotide"
uuuugcuacauacauaugga

SEQ ID NO: 8829 - RNA, 20 nt, Artificial Sequence
  source: /note="Description of Artificial Sequence: Synthetic oligonucleotide"
uuguuuuugcuacauacaua

SEQ ID NO: 8830 - RNA, 20 nt, Artificial Sequence
  source: /note="Description of Artificial Sequence: Synthetic oligonucleotide"
ucuauuucuacagaacuucu

SEQ ID NO: 8831 - RNA, 20 nt, Artificial Sequence
  source: /note="Description of Artificial Sequence: Synthetic oligonucleotide"
agcaguuuugauuacuauug

SEQ ID NO: 8832 - RNA, 20 nt, Artificial Sequence
  source: /note="Description of Artificial Sequence: Synthetic oligonucleotide"
auucuaaauucuuauauucc

SEQ ID NO: 8833 - RNA, 20 nt, Artificial Sequence
  source: /note="Description of Artificial Sequence: Synthetic oligonucleotide"
uaaaacaaaacauuagcaac

SEQ ID NO: 8834 - RNA, 20 nt, Artificial Sequence
  source: /note="Description of Artificial Sequence: Synthetic oligonucleotide"
uagacuucaugcaaagugga

SEQ ID NO: 8835 - RNA, 20 nt, Artificial Sequence
  source: /note="Description of Artificial Sequence: Synthetic oligonucleotide"
gguuuagacuucaugcaaag

SEQ ID NO: 8836 - RNA, 20 nt, Artificial Sequence
  source: /note="Description of Artificial Sequence: Synthetic oligonucleotide"
augaggcuuuuuccaacuga

SEQ ID NO: 8837 - RNA, 20 nt, Artificial Sequence
  source: /note="Description of Artificial Sequence: Synthetic oligonucleotide"
guagaggaauauuaaaaaug

SEQ ID NO: 8838 - RNA, 20 nt, Artificial Sequence
  source: /note="Description of Artificial Sequence: Synthetic oligonucleotide"
caggauuaucagcacaguag

SEQ ID NO: 8839 - RNA, 20 nt, Artificial Sequence
  source: /note="Description of Artificial Sequence: Synthetic oligonucleotide"
cuauucuuuuaguguuauac

SEQ ID NO: 8840 - RNA, 20 nt, Artificial Sequence
  source: /note="Description of Artificial Sequence: Synthetic oligonucleotide"
cgcgguaacgugaggucgga

SEQ ID NO: 8841 - RNA, 20 nt, Artificial Sequence
  source: /note="Description of Artificial Sequence: Synthetic oligonucleotide"
gcgcgguaacgugaggucgg

SEQ ID NO: 8842 - RNA, 20 nt, Artificial Sequence
  source: /note="Description of Artificial Sequence: Synthetic oligonucleotide"
uuggacccuccaccuccagc

SEQ ID NO: 8843 - RNA, 20 nt, Artificial Sequence
  source: /note="Description of Artificial Sequence: Synthetic oligonucleotide"
gagaacuuggacccuccacc

SEQ ID NO: 8844 - RNA, 20 nt, Artificial Sequence
  source: /note="Description of Artificial Sequence: Synthetic oligonucleotide"
uuagagaacuuggacccucc

SEQ ID NO: 8845 - RNA, 20 nt, Artificial Sequence
  source: /note="Description of Artificial Sequence: Synthetic oligonucleotide"
cucuuagagaacuuggaccc

SEQ ID NO: 8846 - RNA, 20 nt, Artificial Sequence
  source: /note="Description of Artificial Sequence: Synthetic oligonucleotide"
guccucuuagagaacuugga

SEQ ID NO: 8847 - RNA, 20 nt, Artificial Sequence
  source: /note="Description of Artificial Sequence: Synthetic oligonucleotide"
cguccucuuagagaacuugg

SEQ ID NO: 8848 - RNA, 20 nt, Artificial Sequence
  source: /note="Description of Artificial Sequence: Synthetic oligonucleotide"
cgaugaucccuccgacuccg

SEQ ID NO: 8849 - RNA, 20 nt, Artificial Sequence
  source: /note="Description of Artificial Sequence: Synthetic oligonucleotide"
gggucgaugaucccuccgac

SEQ ID NO: 8850 - RNA, 20 nt, Artificial Sequence
  source: /note="Description of Artificial Sequence: Synthetic oligonucleotide"
acauuagggucgaugauccc

SEQ ID NO: 8851 - RNA, 20 nt, Artificial Sequence
  source: /note="Description of Artificial Sequence: Synthetic oligonucleotide"
cggacauuagggucgaugau

SEQ ID NO: 8852 - RNA, 20 nt, Artificial Sequence
  source: /note="Description of Artificial Sequence: Synthetic oligonucleotide"
acggacauuagggucgauga

SEQ ID NO: 8853 - RNA, 20 nt, Artificial Sequence
  source: /note="Description of Artificial Sequence: Synthetic oligonucleotide"
uguuuuaaucggcccacacc

SEQ ID NO: 8854 - RNA, 20 nt, Artificial Sequence
  source: /note="Description of Artificial Sequence: Synthetic oligonucleotide"
uuauguuuuaaucggcccac

SEQ ID NO: 8855 - RNA, 20 nt, Artificial Sequence
  source: /note="Description of Artificial Sequence: Synthetic oligonucleotide"
gauuuuuauguuuuaaucgg

SEQ ID NO: 8856 - RNA, 20 nt, Artificial Sequence
  source: /note="Description of Artificial Sequence: Synthetic oligonucleotide"
ugauuuuuauguuuuaaucg

SEQ ID NO: 8857 - RNA, 20 nt, Artificial Sequence
  source: /note="Description of Artificial Sequence: Synthetic oligonucleotide"
gcucuggucggacugguugu

SEQ ID NO: 8858 - RNA, 20 nt, Artificial Sequence
  source: /note="Description of Artificial Sequence: Synthetic oligonucleotide"
cacccguuaguggacuccag

SEQ ID NO: 8859 - RNA, 20 nt, Artificial Sequence
  source: /note="Description of Artificial Sequence: Synthetic oligonucleotide"
ccacccguuaguggacucca

SEQ ID NO: 8860 - RNA, 20 nt, Artificial Sequence
  source: /note="Description of Artificial Sequence: Synthetic oligonucleotide"
ggcuccacccguuaguggac

SEQ ID NO: 8861 - RNA, 20 nt, Artificial Sequence
  source: /note="Description of Artificial Sequence: Synthetic oligonucleotide"
cgugaaacccuccggcucca

SEQ ID NO: 8862 - RNA, 20 nt, Artificial Sequence
  source: /note="Description of Artificial Sequence: Synthetic oligonucleotide"
ccgugaaacccuccggcucc

SEQ ID NO: 8863 - RNA, 20 nt, Artificial Sequence
  source: /note="Description of Artificial Sequence: Synthetic oligonucleotide"
auuccgugaaacccuccggc

SEQ ID NO: 8864 - RNA, 20 nt, Artificial Sequence
  source: /note="Description of Artificial Sequence: Synthetic oligonucleotide"
acggacauuccgugaaaccc

SEQ ID NO: 8865 - RNA, 20 nt, Artificial Sequence
  source: /note="Description of Artificial Sequence: Synthetic oligonucleotide"
aguacggacauuccgugaaa

SEQ ID NO: 8866 - RNA, 20 nt, Artificial Sequence
  source: /note="Description of Artificial Sequence: Synthetic oligonucleotide"
gaguacggacauuccgugaa

SEQ ID NO: 8867 - RNA, 20 nt, Artificial Sequence
  source: /note="Description of Artificial Sequence: Synthetic oligonucleotide"
gcgccgccgaguacggacau

SEQ ID NO: 8868 - RNA, 20 nt, Artificial Sequence
  source: /note="Description of Artificial Sequence: Synthetic oligonucleotide"
agauuucuccgguccgcgcc

SEQ ID NO: 8869 - RNA, 20 nt, Artificial Sequence
  source: /note="Description of Artificial Sequence: Synthetic oligonucleotide"
guaagauuucuccgguccgc

SEQ ID NO: 8870 - RNA, 20 nt, Artificial Sequence
  source: /note="Description of Artificial Sequence: Synthetic oligonucleotide"
aacuuguaagauuucuccgg

SEQ ID NO: 8871 - RNA, 20 nt, Artificial Sequence
  source: /note="Description of Artificial Sequence: Synthetic oligonucleotide"
aaaauaacuuguaagauuuc

SEQ ID NO: 8872 - RNA, 20 nt, Artificial Sequence
  source: /note="Description of Artificial Sequence: Synthetic oligonucleotide"
auuauuuuaaaaccaaucgu

SEQ ID NO: 8873 - RNA, 20 nt, Artificial Sequence
  source: /note="Description of Artificial Sequence: Synthetic oligonucleotide"
aauuauuuuaaaaccaaucg

SEQ ID NO: 8874 - RNA, 20 nt, Artificial Sequence
  source: /note="Description of Artificial Sequence: Synthetic oligonucleotide"
ugcagagaaaaagacacuaa

SEQ ID NO: 8875 - RNA, 20 nt, Artificial Sequence
  source: /note="Description of Artificial Sequence: Synthetic oligonucleotide"
caaaugauucuauaguuugg

SEQ ID NO: 8876 - RNA, 20 nt, Artificial Sequence
  source: /note="Description of Artificial Sequence: Synthetic oligonucleotide"
cagcaaaugauucuauaguu

SEQ ID NO: 8877 - RNA, 20 nt, Artificial Sequence
  source: /note="Description of Artificial Sequence: Synthetic oligonucleotide"
uaaacagcaaaggacaaauu

SEQ ID NO: 8878 - RNA, 20 nt, Artificial Sequence
  source: /note="Description of Artificial Sequence: Synthetic oligonucleotide"
guuagaguuuuaaacagcaa

SEQ ID NO: 8879 - RNA, 20 nt, Artificial Sequence
  source: /note="Description of Artificial Sequence: Synthetic oligonucleotide"
gguacacaccauaaaauuuu

SEQ ID NO: 8880 - RNA, 20 nt, Artificial Sequence
  source: /note="Description of Artificial Sequence: Synthetic oligonucleotide"
aaucauuuguaaaagugguc

SEQ ID NO: 8881 - RNA, 20 nt, Artificial Sequence
  source: /note="Description of Artificial Sequence: Synthetic oligonucleotide"
caauuaaucauuuguaaaag

SEQ ID NO: 8882 - RNA, 20 nt, Artificial Sequence
  source: /note="Description of Artificial Sequence: Synthetic oligonucleotide"
cgugguaacgugaggucgga

SEQ ID NO: 8883 - RNA, 20 nt, Artificial Sequence
  source: /note="Description of Artificial Sequence: Synthetic oligonucleotide"
gcgugguaacgugaggucgg

SEQ ID NO: 8884 - RNA, 20 nt, Artificial Sequence
  source: /note="Description of Artificial Sequence: Synthetic oligonucleotide"
acgaacuuggguccucuacc

SEQ ID NO: 8885 - RNA, 20 nt, Artificial Sequence
  source: /note="Description of Artificial Sequence: Synthetic oligonucleotide"
uuaacgaacuuggguccucu

SEQ ID NO: 8886 - RNA, 20 nt, Artificial Sequence
  source: /note="Description of Artificial Sequence: Synthetic oligonucleotide"
guccucuuaacgaacuuggg

SEQ ID NO: 8887 - RNA, 20 nt, Artificial Sequence
  source: /note="Description of Artificial Sequence: Synthetic oligonucleotide"
cgauaagcccuccgacuccg

SEQ ID NO: 8888 - RNA, 20 nt, Artificial Sequence
  source: /note="Description of Artificial Sequence: Synthetic oligonucleotide"
gggucgauaagcccuccgac

SEQ ID NO: 8889 - RNA, 20 nt, Artificial Sequence
  source: /note="Description of Artificial Sequence: Synthetic oligonucleotide"
acauuagggucgauaagccc

SEQ ID NO: 8890 - RNA, 20 nt, Artificial Sequence
  source: /note="Description of Artificial Sequence: Synthetic oligonucleotide"
cggacauuagggucgauaag

SEQ ID NO: 8891 - RNA, 20 nt, Artificial Sequence
  source: /note="Description of Artificial Sequence: Synthetic oligonucleotide"
acggacauuagggucgauaa

SEQ ID NO: 8892 - RNA, 20 nt, Artificial Sequence
  source: /note="Description of Artificial Sequence: Synthetic oligonucleotide"
uuauguuuuaaucgacccac

SEQ ID NO: 8893 - RNA, 20 nt, Artificial Sequence
  source: /note="Description of Artificial Sequence: Synthetic oligonucleotide"
gauuuuuauguuuuaaucga

SEQ ID NO: 8894 - RNA, 20 nt, Artificial Sequence
  source: /note="Description of Artificial Sequence: Synthetic oligonucleotide"
ugauuuuuauguuuuaaucg

SEQ ID NO: 8895 - RNA, 20 nt, Artificial Sequence
  source: /note="Description of Artificial Sequence: Synthetic oligonucleotide"
ggucuggucggacuaguugu

SEQ ID NO: 8896 - RNA, 20 nt, Artificial Sequence
  source: /note="Description of Artificial Sequence: Synthetic oligonucleotide"
gcccgccuagugggcuccag

SEQ ID NO: 8897 - RNA, 20 nt, Artificial Sequence
  source: /note="Description of Artificial Sequence: Synthetic oligonucleotide"
gcuccgcccgccuagugggc

SEQ ID NO: 8898 - RNA, 20 nt, Artificial Sequence
  source: /note="Description of Artificial Sequence: Synthetic oligonucleotide"
gagacccuccggcuccgccc

SEQ ID NO: 8899 - RNA, 20 nt, Artificial Sequence
  source: /note="Description of Artificial Sequence: Synthetic oligonucleotide"
cgugagacccuccggcuccg

SEQ ID NO: 8900 - RNA, 20 nt, Artificial Sequence
  source: /note="Description of Artificial Sequence: Synthetic oligonucleotide"
ucgugagacccuccggcucc

SEQ ID NO: 8901 - RNA, 20 nt, Artificial Sequence
  source: /note="Description of Artificial Sequence: Synthetic oligonucleotide"
gggucgugagacccuccggc

SEQ ID NO: 8902 - RNA, 20 nt, Artificial Sequence
  source: /note="Description of Artificial Sequence: Synthetic oligonucleotide"
acauuagggucgugagaccc

SEQ ID NO: 8903 - RNA, 20 nt, Artificial Sequence
  source: /note="Description of Artificial Sequence: Synthetic oligonucleotide"
cggacauuagggucgugaga

SEQ ID NO: 8904 - RNA, 20 nt, Artificial Sequence
  source: /note="Description of Artificial Sequence: Synthetic oligonucleotide"
acggacauuagggucgugag

SEQ ID NO: 8905 - RNA, 20 nt, Artificial Sequence
  source: /note="Description of Artificial Sequence: Synthetic oligonucleotide"
auauuucaccgacccguguc

SEQ ID NO: 8906 - RNA, 20 nt, Artificial Sequence
  source: /note="Description of Artificial Sequence: Synthetic oligonucleotide"
uuaaaaaaauauuucaccga

SEQ ID NO: 8907 - RNA, 20 nt, Artificial Sequence
  source: /note="Description of Artificial Sequence: Synthetic oligonucleotide"
auuaaaaaaauauuucaccg

SEQ ID NO: 8908 - RNA, 20 nt, Artificial Sequence
  source: /note="Description of Artificial Sequence: Synthetic oligonucleotide"
guagauuaaaaaaauauuuc

SEQ ID NO: 8909 - RNA, 20 nt, Artificial Sequence
  source: /note="Description of Artificial Sequence: Synthetic oligonucleotide"
agaaagagcaagaggaguca

SEQ ID NO: 8910 - RNA, 20 nt, Artificial Sequence
  source: /note="Description of Artificial Sequence: Synthetic oligonucleotide"
cagaaagagcaagaggaguc

SEQ ID NO: 8911 - RNA, 20 nt, Artificial Sequence
  source: /note="Description of Artificial Sequence: Synthetic oligonucleotide"
uuuucuucagaaagagcaag

SEQ ID NO: 8912 - RNA, 20 nt, Artificial Sequence
  source: /note="Description of Artificial Sequence: Synthetic oligonucleotide"
uuaauuuuuuuucuaauuaa

SEQ ID NO: 8913 - RNA, 20 nt, Artificial Sequence
  source: /note="Description of Artificial Sequence: Synthetic oligonucleotide"
aaaacuaucauuuucacaag

SEQ ID NO: 8914 - RNA, 20 nt, Artificial Sequence
  source: /note="Description of Artificial Sequence: Synthetic oligonucleotide"
aaaaucaaacauuuugcaau

SEQ ID NO: 8915 - RNA, 20 nt, Artificial Sequence
  source: /note="Description of Artificial Sequence: Synthetic oligonucleotide"
augaaugaaauauaguuucc

SEQ ID NO: 8916 - RNA, 20 nt, Artificial Sequence
  source: /note="Description of Artificial Sequence: Synthetic oligonucleotide"
uugggcccuccaccuccaac

SEQ ID NO: 8917 - RNA, 20 nt, Artificial Sequence
  source: /note="Description of Artificial Sequence: Synthetic oligonucleotide"
gugaacuugggcccuccacc

SEQ ID NO: 8918 - RNA, 20 nt, Artificial Sequence
  source: /note="Description of Artificial Sequence: Synthetic oligonucleotide"
uuagugaacuugggcccucc

SEQ ID NO: 8919 - RNA, 20 nt, Artificial Sequence
  source: /note="Description of Artificial Sequence: Synthetic oligonucleotide"
cucuuagugaacuugggccc

SEQ ID NO: 8920 - RNA, 20 nt, Artificial Sequence
  source: /note="Description of Artificial Sequence: Synthetic oligonucleotide"
guacucuuagugaacuuggg

SEQ ID NO: 8921 - RNA, 20 nt, Artificial Sequence
  source: /note="Description of Artificial Sequence: Synthetic oligonucleotide"
cguacucuuagugaacuugg

SEQ ID NO: 8922 - RNA, 20 nt, Artificial Sequence
  source: /note="Description of Artificial Sequence: Synthetic oligonucleotide"
agaucgaugagcccuccgac

SEQ ID NO: 8923 - RNA, 20 nt, Artificial Sequence
  source: /note="Description of Artificial Sequence: Synthetic oligonucleotide"
acauuaagaucgaugagccc

SEQ ID NO: 8924 - RNA, 20 nt, Artificial Sequence
  source: /note="Description of Artificial Sequence: Synthetic oligonucleotide"
cggacauuaagaucgaugag

SEQ ID NO: 8925 - RNA, 20 nt, Artificial Sequence
  source: /note="Description of Artificial Sequence: Synthetic oligonucleotide"
acggacauuaagaucgauga

SEQ ID NO: 8926 - RNA, 20 nt, Artificial Sequence
  source: /note="Description of Artificial Sequence: Synthetic oligonucleotide"
uuauguuuuuacucggccca

SEQ ID NO: 8927 - RNA, 20 nt, Artificial Sequence
  source: /note="Description of Artificial Sequence: Synthetic oligonucleotide"
uuuauguuuuuacucggccc

SEQ ID NO: 8928 - RNA, 20 nt, Artificial Sequence
  source: /note="Description of Artificial Sequence: Synthetic oligonucleotide"
auuuuuauguuuuuacucgg

SEQ ID NO: 8929 - RNA, 20 nt, Artificial Sequence
  source: /note="Description of Artificial Sequence: Synthetic oligonucleotide"
gauuuuuauguuuuuacucg

SEQ ID NO: 8930 - RNA, 20 nt, Artificial Sequence
  source: /note="Description of Artificial Sequence: Synthetic oligonucleotide"
gcucuaguuagaccgguugu

SEQ ID NO: 8931 - RNA, 20 nt, Artificial Sequence
  source: /note="Description of Artificial Sequence: Synthetic oligonucleotide"
gguccucaagcucuaguuag

SEQ ID NO: 8932 - RNA, 20 nt, Artificial Sequence
  source: /note="Description of Artificial Sequence: Synthetic oligonucleotide"
acccacccaauggacuucgg

SEQ ID NO: 8933 - RNA, 20 nt, Artificial Sequence
  source: /note="Description of Artificial Sequence: Synthetic oligonucleotide"
aaacccuccggucccaccca

SEQ ID NO: 8934 - RNA, 20 nt, Artificial Sequence
  source: /note="Description of Artificial Sequence: Synthetic oligonucleotide"
gaaacccuccggucccaccc

SEQ ID NO: 8935 - RNA, 20 nt, Artificial Sequence
  source: /note="Description of Artificial Sequence: Synthetic oligonucleotide"
cgugaaacccuccgguccca

SEQ ID NO: 8936 - RNA, 20 nt, Artificial Sequence
  source: /note="Description of Artificial Sequence: Synthetic oligonucleotide"
ucgugaaacccuccgguccc

SEQ ID NO: 8937 - RNA, 20 nt, Artificial Sequence
  source: /note="Description of Artificial Sequence: Synthetic oligonucleotide"
gggucgugaaacccuccggu

SEQ ID NO: 8938 - RNA, 20 nt, Artificial Sequence
  source: /note="Description of Artificial Sequence: Synthetic oligonucleotide"
agggucgugaaacccuccgg

SEQ ID NO: 8939 - RNA, 20 nt, Artificial Sequence
  source: /note="Description of Artificial Sequence: Synthetic oligonucleotide"
acauuagggucgugaaaccc

SEQ ID NO: 8940 - RNA, 20 nt, Artificial Sequence
  source: /note="Description of Artificial Sequence: Synthetic oligonucleotide"
uggacauuagggucgugaaa

SEQ ID NO: 8941 - RNA, 20 nt, Artificial Sequence
  source: /note="Description of Artificial Sequence: Synthetic oligonucleotide"
guggacauuagggucgugaa

SEQ ID NO: 8942 - RNA, 20 nt, Artificial Sequence
  source: /note="Description of Artificial Sequence: Synthetic oligonucleotide"
gaaaagcuccgacccguacc

SEQ ID NO: 8943 - RNA, 20 nt, Artificial Sequence
  source: /note="Description of Artificial Sequence: Synthetic oligonucleotide"
auggaaaagcuccgacccgu

SEQ ID NO: 8944 - RNA, 20 nt, Artificial Sequence
  source: /note="Description of Artificial Sequence: Synthetic oligonucleotide"
gaauuauggaaaagcuccga

SEQ ID NO: 8945 - RNA, 20 nt, Artificial Sequence
  source: /note="Description of Artificial Sequence: Synthetic oligonucleotide"
agaauuauggaaaagcuccg

SEQ ID NO: 8946 - RNA, 20 nt, Artificial Sequence
  source: /note="Description of Artificial Sequence: Synthetic oligonucleotide"
uauaagaauuauggaaaagc

SEQ ID NO: 8947 - RNA, 20 nt, Artificial Sequence
  source: /note="Description of Artificial Sequence: Synthetic oligonucleotide"
auuggcauuuauaagaauua

SEQ ID NO: 8948 - RNA, 20 nt, Artificial Sequence
  source: /note="Description of Artificial Sequence: Synthetic oligonucleotide"
ucagauuccauuucaggcau

SEQ ID NO: 8949 - RNA, 20 nt, Artificial Sequence
  source: /note="Description of Artificial Sequence: Synthetic oligonucleotide"
uauaugucagauuccauuuc

SEQ ID NO: 8950 - RNA, 20 nt, Artificial Sequence
  source: /note="Description of Artificial Sequence: Synthetic oligonucleotide"
ucugguccaacuauuuuuca

SEQ ID NO: 8951 - RNA, 20 nt, Artificial Sequence
  source: /note="Description of Artificial Sequence: Synthetic oligonucleotide"
cuacaagcuuucugagacuc

SEQ ID NO: 8952 - RNA, 20 nt, Artificial Sequence
  source: /note="Description of Artificial Sequence: Synthetic oligonucleotide"
aguauuaaaauuuuuuauuu

SEQ ID NO: 8953 - RNA, 20 nt, Artificial Sequence
  source: /note="Description of Artificial Sequence: Synthetic oligonucleotide"
aguaaagucuguauugacau

SEQ ID NO: 8954 - RNA, 20 nt, Artificial Sequence
  source: /note="Description of Artificial Sequence: Synthetic oligonucleotide"
uaaaauaaaaucuauuuaug

SEQ ID NO: 8955 - RNA, 20 nt, Artificial Sequence
  source: /note="Description of Artificial Sequence: Synthetic oligonucleotide"
auaaaauaaaaucuauuuau

SEQ ID NO: 8956 - RNA, 20 nt, Artificial Sequence
  source: /note="Description of Artificial Sequence: Synthetic oligonucleotide"
cauaaaauaaaaucuauuua

SEQ ID NO: 8957 - RNA, 20 nt, Artificial Sequence
  source: /note="Description of Artificial Sequence: Synthetic oligonucleotide"
auuauucuauucucuguucu

SEQ ID NO: 8958 - RNA, 20 nt, Artificial Sequence
  source: /note="Description of Artificial Sequence: Synthetic oligonucleotide"
uuuguaagaacucagugaug

SEQ ID NO: 8959 - RNA, 20 nt, Artificial Sequence
  source: /note="Description of Artificial Sequence: Synthetic oligonucleotide"
guuuggagcauguggacaca

SEQ ID NO: 8960 - RNA, 20 nt, Artificial Sequence
  source: /note="Description of Artificial Sequence: Synthetic oligonucleotide"
gguuuggagcauguggacac

SEQ ID NO: 8961 - RNA, 20 nt, Artificial Sequence
  source: /note="Description of Artificial Sequence: Synthetic oligonucleotide"
agugggugguuuggagcaug

SEQ ID NO: 8962 - RNA, 20 nt, Artificial Sequence
  source: /note="Description of Artificial Sequence: Synthetic oligonucleotide"
ugaacucacagugggugguu

SEQ ID NO: 8963 - RNA, 20 nt, Artificial Sequence
  source: /note="Description of Artificial Sequence: Synthetic oligonucleotide"
uuuucugaacucacaguggg

SEQ ID NO: 8964 - RNA, 20 nt, Artificial Sequence
  source: /note="Description of Artificial Sequence: Synthetic oligonucleotide"
uucuuuucugaacucacagu

SEQ ID NO: 8965 - RNA, 20 nt, Artificial Sequence
  source: /note="Description of Artificial Sequence: Synthetic oligonucleotide"
guucuuuucugaacucacag

SEQ ID NO: 8966 - RNA, 20 nt, Artificial Sequence
  source: /note="Description of Artificial Sequence: Synthetic oligonucleotide"
aaacagcugguuuggcucaa

SEQ ID NO: 8967 - RNA, 20 nt, Artificial Sequence
  source: /note="Description of Artificial Sequence: Synthetic oligonucleotide"
uaaagaagaaacagcugguu

SEQ ID NO: 8968 - RNA, 20 nt, Artificial Sequence
  source: /note="Description of Artificial Sequence: Synthetic oligonucleotide"
aucuuuaaagaagaaacagc

SEQ ID NO: 8969 - RNA, 20 nt, Artificial Sequence
  source: /note="Description of Artificial Sequence: Synthetic oligonucleotide"
cauaaaauggaaaucucaaa

SEQ ID NO: 8970 - RNA, 20 nt, Artificial Sequence
  source: /note="Description of Artificial Sequence: Synthetic oligonucleotide"
ucauaaaauggaaaucucaa

SEQ ID NO: 8971 - RNA, 20 nt, Artificial Sequence
  source: /note="Description of Artificial Sequence: Synthetic oligonucleotide"
gguuagacuuagucauaaaa

SEQ ID NO: 8972 - RNA, 20 nt, Artificial Sequence
  source: /note="Description of Artificial Sequence: Synthetic oligonucleotide"
cuuacuugccaaaaaaauac

SEQ ID NO: 8973 - RNA, 20 nt, Artificial Sequence
  source: /note="Description of Artificial Sequence: Synthetic oligonucleotide"
accauggcagaaggcauuuc

SEQ ID NO: 8974 - RNA, 20 nt, Artificial Sequence
  source: /note="Description of Artificial Sequence: Synthetic oligonucleotide"
acaucacccaccauggcaga

SEQ ID NO: 8975 - RNA, 20 nt, Artificial Sequence
  source: /note="Description of Artificial Sequence: Synthetic oligonucleotide"
auguuuaacaucacccacca

SEQ ID NO: 8976 - RNA, 20 nt, Artificial Sequence
  source: /note="Description of Artificial Sequence: Synthetic oligonucleotide"
cuacgacacacuacccaggu

SEQ ID NO: 8977 - RNA, 20 nt, Artificial Sequence
  source: /note="Description of Artificial Sequence: Synthetic oligonucleotide"
uuuauaacuacgacacacua

SEQ ID NO: 8978 - RNA, 20 nt, Artificial Sequence
  source: /note="Description of Artificial Sequence: Synthetic oligonucleotide"
auuuauaacuacgacacacu

SEQ ID NO: 8979 - RNA, 20 nt, Artificial Sequence
  source: /note="Description of Artificial Sequence: Synthetic oligonucleotide"
ugugaucacccucaccuaca

SEQ ID NO: 8980 - RNA, 20 nt, Artificial Sequence
  source: /note="Description of Artificial Sequence: Synthetic oligonucleotide"
uugugaucacccucaccuac

SEQ ID NO: 8981 - RNA, 20 nt, Artificial Sequence
  source: /note="Description of Artificial Sequence: Synthetic oligonucleotide"
gaaaguuugugaucacccuc

SEQ ID NO: 8982 - RNA, 20 nt, Artificial Sequence
  source: /note="Description of Artificial Sequence: Synthetic oligonucleotide"
aagacgaaaguuugugauca

SEQ ID NO: 8983 - RNA, 20 nt, Artificial Sequence
  source: /note="Description of Artificial Sequence: Synthetic oligonucleotide"
gaagacgaaaguuugugauc

SEQ ID NO: 8984 - RNA, 20 nt, Artificial Sequence
  source: /note="Description of Artificial Sequence: Synthetic oligonucleotide"
acuuuacaauuguccauucu

SEQ ID NO: 8985 - RNA, 20 nt, Artificial Sequence
  source: /note="Description of Artificial Sequence: Synthetic oligonucleotide"
uauguaggacuuuacaauug

SEQ ID NO: 8986 - RNA, 20 nt, Artificial Sequence
  source: /note="Description of Artificial Sequence: Synthetic oligonucleotide"
cuucacaguuaguacaccuu

SEQ ID NO: 8987 - RNA, 20 nt, Artificial Sequence
  source: /note="Description of Artificial Sequence: Synthetic oligonucleotide"
ucuucacaguuaguacaccu

SEQ ID NO: 8988 - RNA, 20 nt, Artificial Sequence
  source: /note="Description of Artificial Sequence: Synthetic oligonucleotide"
ugagucuucacaguuaguac

SEQ ID NO: 8989 - RNA, 20 nt, Artificial Sequence
  source: /note="Description of Artificial Sequence: Synthetic oligonucleotide"
ggucuguuaccuguacuuga

SEQ ID NO: 8990 - RNA, 20 nt, Artificial Sequence
  source: /note="Description of Artificial Sequence: Synthetic oligonucleotide"
gggucuguuaccuguacuug

SEQ ID NO: 8991 - RNA, 20 nt, Artificial Sequence
  source: /note="Description of Artificial Sequence: Synthetic oligonucleotide"
aauuaucgauagggucuguu

SEQ ID NO: 8992 - RNA, 20 nt, Artificial Sequence
  source: /note="Description of Artificial Sequence: Synthetic oligonucleotide"
uuaccucucuuaaaauacuc

SEQ ID NO: 8993 - RNA, 20 nt, Artificial Sequence
  source: /note="Description of Artificial Sequence: Synthetic oligonucleotide"
gugucuuaaauagaagauuu

SEQ ID NO: 8994 - RNA, 20 nt, Artificial Sequence
  source: /note="Description of Artificial Sequence: Synthetic oligonucleotide"
cccgauaauauuuauuuuuc

SEQ ID NO: 8995 - RNA, 20 nt, Artificial Sequence
  source: /note="Description of Artificial Sequence: Synthetic oligonucleotide"
uuaaguauuucuuuccccuu

SEQ ID NO: 8996 - RNA, 20 nt, Artificial Sequence
  source: /note="Description of Artificial Sequence: Synthetic oligonucleotide"
uuuaaguauuucuuuccccu

SEQ ID NO: 8997 - RNA, 20 nt, Artificial Sequence
  source: /note="Description of Artificial Sequence: Synthetic oligonucleotide"
uaaguuuaaguauuucuuuc

SEQ ID NO: 8998 - RNA, 20 nt, Artificial Sequence
  source: /note="Description of Artificial Sequence: Synthetic oligonucleotide"
uuaaguuuaaguauuucuuu

SEQ ID NO: 8999 - RNA, 20 nt, Artificial Sequence
  source: /note="Description of Artificial Sequence: Synthetic oligonucleotide"
uuuaaguuuaaguauuucuu

SEQ ID NO: 9000 - RNA, 20 nt, Artificial Sequence
  source: /note="Description of Artificial Sequence: Synthetic oligonucleotide"
agccgguuuaggucuuacac

SEQ ID NO: 9001 - RNA, 20 nt, Artificial Sequence
  source: /note="Description of Artificial Sequence: Synthetic oligonucleotide"
uagccgguuuaggucuuaca

SEQ ID NO: 9002 - RNA, 20 nt, Artificial Sequence
  source: /note="Description of Artificial Sequence: Synthetic oligonucleotide"
uuagccgguuuaggucuuac

SEQ ID NO: 9003 - RNA, 20 nt, Artificial Sequence
  source: /note="Description of Artificial Sequence: Synthetic oligonucleotide"
guuuucuugguucuacuuua

SEQ ID NO: 9004 - RNA, 20 nt, Artificial Sequence
  source: /note="Description of Artificial Sequence: Synthetic oligonucleotide"
cuaugaccccuaucuccuua

SEQ ID NO: 9005 - RNA, 20 nt, Artificial Sequence
  source: /note="Description of Artificial Sequence: Synthetic oligonucleotide"
ugucuucuaugaccccuauc

SEQ ID NO: 9006 - RNA, 20 nt, Artificial Sequence
  source: /note="Description of Artificial Sequence: Synthetic oligonucleotide"
ggucaggugucuucuaugac

SEQ ID NO: 9007 - RNA, 20 nt, Artificial Sequence
  source: /note="Description of Artificial Sequence: Synthetic oligonucleotide"
uggucaggugucuucuauga

SEQ ID NO: 9008 - RNA, 20 nt, Artificial Sequence
  source: /note="Description of Artificial Sequence: Synthetic oligonucleotide"
auggucaggugucuucuaug

SEQ ID NO: 9009 - RNA, 20 nt, Artificial Sequence
  source: /note="Description of Artificial Sequence: Synthetic oligonucleotide"
ccaacgucacucgacucuaa

SEQ ID NO: 9010 - RNA, 20 nt, Artificial Sequence
  source: /note="Description of Artificial Sequence: Synthetic oligonucleotide"
uccaacgucacucgacucua

SEQ ID NO: 9011 - RNA, 20 nt, Artificial Sequence
  source: /note="Description of Artificial Sequence: Synthetic oligonucleotide"
ucgaacuuggacccuccacc

SEQ ID NO: 9012 - RNA, 20 nt, Artificial Sequence
  source: /note="Description of Artificial Sequence: Synthetic oligonucleotide"
uuaucgaacuuggacccucc

SEQ ID NO: 9013 - RNA, 20 nt, Artificial Sequence
  source: /note="Description of Artificial Sequence: Synthetic oligonucleotide"
cucuuaucgaacuuggaccc

SEQ ID NO: 9014 - RNA, 20 nt, Artificial Sequence
  source: /note="Description of Artificial Sequence: Synthetic oligonucleotide"
guacucuuaucgaacuugga

SEQ ID NO: 9015 - RNA, 20 nt, Artificial Sequence
  source: /note="Description of Artificial Sequence: Synthetic oligonucleotide"
cguacucuuaucgaacuugg

SEQ ID NO: 9016 - RNA, 20 nt, Artificial Sequence
  source: /note="Description of Artificial Sequence: Synthetic oligonucleotide"
gggucaaugaguccuccgac

SEQ ID NO: 9017 - RNA, 20 nt, Artificial Sequence
  source: /note="Description of Artificial Sequence: Synthetic oligonucleotide"
acgucagggucaaugagucc

SEQ ID NO: 9018 - RNA, 20 nt, Artificial Sequence
  source: /note="Description of Artificial Sequence: Synthetic oligonucleotide"
cgaacgucagggucaaugag

SEQ ID NO: 9019 - RNA, 20 nt, Artificial Sequence
  source: /note="Description of Artificial Sequence: Synthetic oligonucleotide"
guuuuuagucguccuacucc

SEQ ID NO: 9020 - RNA, 20 nt, Artificial Sequence
  source: /note="Description of Artificial Sequence: Synthetic oligonucleotide"
cauguuuuuagucguccuac

SEQ ID NO: 9021 - RNA, 20 nt, Artificial Sequence
  source: /note="Description of Artificial Sequence: Synthetic oligonucleotide"
gauuuucauguuuuuagucg

SEQ ID NO: 9022 - RNA, 20 nt, Artificial Sequence
  source: /note="Description of Artificial Sequence: Synthetic oligonucleotide"
ggucuggucggaccgguugu

SEQ ID NO: 9023 - RNA, 20 nt, Artificial Sequence
  source: /note="Description of Artificial Sequence: Synthetic oligonucleotide"
gguccucaaggucuggucgg

SEQ ID NO: 9024 - RNA, 20 nt, Artificial Sequence
  source: /note="Description of Artificial Sequence: Synthetic oligonucleotide"
acccgccuagugaacuccgg

SEQ ID NO: 9025 - RNA, 20 nt, Artificial Sequence
  source: /note="Description of Artificial Sequence: Synthetic oligonucleotide"
guuccacccgccuagugaac

SEQ ID NO: 9026 - RNA, 20 nt, Artificial Sequence
  source: /note="Description of Artificial Sequence: Synthetic oligonucleotide"
gaaacccuccgguuccaccc

SEQ ID NO: 9027 - RNA, 20 nt, Artificial Sequence
  source: /note="Description of Artificial Sequence: Synthetic oligonucleotide"
cgugaaacccuccgguucca

SEQ ID NO: 9028 - RNA, 20 nt, Artificial Sequence
  source: /note="Description of Artificial Sequence: Synthetic oligonucleotide"
ucgugaaacccuccgguucc

SEQ ID NO: 9029 - RNA, 20 nt, Artificial Sequence
  source: /note="Description of Artificial Sequence: Synthetic oligonucleotide"
gggucgugaaacccuccggu

SEQ ID NO: 9030 - RNA, 20 nt, Artificial Sequence
  source: /note="Description of Artificial Sequence: Synthetic oligonucleotide"
acauuagggucgugaaaccc

SEQ ID NO: 9031 - RNA, 20 nt, Artificial Sequence
  source: /note="Description of Artificial Sequence: Synthetic oligonucleotide"
cggacauuagggucgugaaa

SEQ ID NO: 9032 - RNA, 20 nt, Artificial Sequence
  source: /note="Description of Artificial Sequence: Synthetic oligonucleotide"
acggacauuagggucgugaa

SEQ ID NO: 9033 - RNA, 20 nt, Artificial Sequence
  source: /note="Description of Artificial Sequence: Synthetic oligonucleotide"
uauaaugaauuuuuagucga

SEQ ID NO: 9034 - RNA, 20 nt, Artificial Sequence
  source: /note="Description of Artificial Sequence: Synthetic oligonucleotide"
auauaaugaauuuuuagucg

SEQ ID NO: 9035 - RNA, 20 nt, Artificial Sequence
  source: /note="Description of Artificial Sequence: Synthetic oligonucleotide"
ugagaauuauagugauuuua

SEQ ID NO: 9036 - RNA, 20 nt, Artificial Sequence
  source: /note="Description of Artificial Sequence: Synthetic oligonucleotide"
gugagaauuauagugauuuu

SEQ ID NO: 9037 - RNA, 20 nt, Artificial Sequence
  source: /note="Description of Artificial Sequence: Synthetic oligonucleotide"
cuucuuguauuacuaccuag

SEQ ID NO: 9038 - RNA, 20 nt, Artificial Sequence
  source: /note="Description of Artificial Sequence: Synthetic oligonucleotide"
aaacuacuucuuguauuacu

SEQ ID NO: 9039 - RNA, 20 nt, Artificial Sequence
  source: /note="Description of Artificial Sequence: Synthetic oligonucleotide"
aguuaacuacacuuugauag

SEQ ID NO: 9040 - RNA, 20 nt, Artificial Sequence
  source: /note="Description of Artificial Sequence: Synthetic oligonucleotide"
gaauuguuuuauuaucuuug

SEQ ID NO: 9041 - RNA, 20 nt, Artificial Sequence
  source: /note="Description of Artificial Sequence: Synthetic oligonucleotide"
auauuuuuaaaguaaaaauu

SEQ ID NO: 9042 - RNA, 20 nt, Artificial Sequence
  source: /note="Description of Artificial Sequence: Synthetic oligonucleotide"
uuaaccuuugauuuacuauu

SEQ ID NO: 9043 - RNA, 20 nt, Artificial Sequence
  source: /note="Description of Artificial Sequence: Synthetic oligonucleotide"
cucaugguaaaugauauaaa

SEQ ID NO: 9044 - RNA, 20 nt, Artificial Sequence
  source: /note="Description of Artificial Sequence: Synthetic oligonucleotide"
gcucaugguaaaugauauaa

SEQ ID NO: 9045 - RNA, 20 nt, Artificial Sequence
  source: /note="Description of Artificial Sequence: Synthetic oligonucleotide"
augacuugaaauuuggcuca

SEQ ID NO: 9046 - RNA, 20 nt, Artificial Sequence
  source: /note="Description of Artificial Sequence: Synthetic oligonucleotide"
uuuuaauaugacuugaaauu

SEQ ID NO: 9047 - RNA, 20 nt, Artificial Sequence
  source: /note="Description of Artificial Sequence: Synthetic oligonucleotide"
agguauauuuauuuugauag

SEQ ID NO: 9048 - RNA, 20 nt, Artificial Sequence
  source: /note="Description of Artificial Sequence: Synthetic oligonucleotide"
aagguauauuuauuuugaua

SEQ ID NO: 9049 - RNA, 20 nt, Artificial Sequence
  source: /note="Description of Artificial Sequence: Synthetic oligonucleotide"
aaagguauauuuauuuugau

SEQ ID NO: 9050 - RNA, 20 nt, Artificial Sequence
  source: /note="Description of Artificial Sequence: Synthetic oligonucleotide"
cuaauaaaguggcuacuaaa

SEQ ID NO: 9051 - RNA, 20 nt, Artificial Sequence
  source: /note="Description of Artificial Sequence: Synthetic oligonucleotide"
aaguugauuuucuaauaaag

SEQ ID NO: 9052 - RNA, 20 nt, Artificial Sequence
  source: /note="Description of Artificial Sequence: Synthetic oligonucleotide"
aguuauagaaaaaaacaugg

SEQ ID NO: 9053 - RNA, 20 nt, Artificial Sequence
  source: /note="Description of Artificial Sequence: Synthetic oligonucleotide"
gaguuauagaaaaaaacaug

SEQ ID NO: 9054 - RNA, 20 nt, Artificial Sequence
  source: /note="Description of Artificial Sequence: Synthetic oligonucleotide"
agaguuauagaaaaaaacau

SEQ ID NO: 9055 - RNA, 20 nt, Artificial Sequence
  source: /note="Description of Artificial Sequence: Synthetic oligonucleotide"
uagaguuauagaaaaaaaca

SEQ ID NO: 9056 - RNA, 20 nt, Artificial Sequence
  source: /note="Description of Artificial Sequence: Synthetic oligonucleotide"
gaaauuuucccauuuaaaau

SEQ ID NO: 9057 - RNA, 20 nt, Artificial Sequence
  source: /note="Description of Artificial Sequence: Synthetic oligonucleotide"
gacuuaacauaugaaauuuu

SEQ ID NO: 9058 - RNA, 20 nt, Artificial Sequence
  source: /note="Description of Artificial Sequence: Synthetic oligonucleotide"
ugacuuaacauaugaaauuu

SEQ ID NO: 9059 - RNA, 20 nt, Artificial Sequence
  source: /note="Description of Artificial Sequence: Synthetic oligonucleotide"
uugcaagacuuugauccauc

SEQ ID NO: 9060 - RNA, 20 nt, Artificial Sequence
  source: /note="Description of Artificial Sequence: Synthetic oligonucleotide"
cuacuuuugcaagacuuuga

SEQ ID NO: 9061 - RNA, 20 nt, Artificial Sequence
  source: /note="Description of Artificial Sequence: Synthetic oligonucleotide"
auuuaugucccaaaggaaga

SEQ ID NO: 9062 - RNA, 20 nt, Artificial Sequence
  source: /note="Description of Artificial Sequence: Synthetic oligonucleotide"
uauuuaugucccaaaggaag

SEQ ID NO: 9063 - RNA, 20 nt, Artificial Sequence
  source: /note="Description of Artificial Sequence: Synthetic oligonucleotide"
cacugacggauuauuuaugu

SEQ ID NO: 9064 - RNA, 20 nt, Artificial Sequence
  source: /note="Description of Artificial Sequence: Synthetic oligonucleotide"
ucacugacggauuauuuaug

SEQ ID NO: 9065 - RNA, 20 nt, Artificial Sequence
  source: /note="Description of Artificial Sequence: Synthetic oligonucleotide"
ccuuccuucuuccccucuuc

SEQ ID NO: 9066 - RNA, 20 nt, Artificial Sequence
  source: /note="Description of Artificial Sequence: Synthetic oligonucleotide"
uccuuccuucuuccccucuu

SEQ ID NO: 9067 - RNA, 20 nt, Artificial Sequence
  source: /note="Description of Artificial Sequence: Synthetic oligonucleotide"
cuccuuccuucuuccccucu

SEQ ID NO: 9068 - RNA, 20 nt, Artificial Sequence
  source: /note="Description of Artificial Sequence: Synthetic oligonucleotide"
gugaaucuccuuccuucuuc

SEQ ID NO: 9069 - RNA, 20 nt, Artificial Sequence
  source: /note="Description of Artificial Sequence: Synthetic oligonucleotide"
ggugaaucuccuuccuucuu

SEQ ID NO: 9070 - RNA, 20 nt, Artificial Sequence
  source: /note="Description of Artificial Sequence: Synthetic oligonucleotide"
cggugaaucuccuuccuucu

SEQ ID NO: 9071 - RNA, 20 nt, Artificial Sequence
  source: /note="Description of Artificial Sequence: Synthetic oligonucleotide"
acaccaacggugaaucuccu

SEQ ID NO: 9072 - RNA, 20 nt, Artificial Sequence
  source: /note="Description of Artificial Sequence: Synthetic oligonucleotide"
auaaacaccaacggugaauc

SEQ ID NO: 9073 - RNA, 20 nt, Artificial Sequence
  source: /note="Description of Artificial Sequence: Synthetic oligonucleotide"
ucuuugacuuacaaauaaac

SEQ ID NO: 9074 - RNA, 20 nt, Artificial Sequence
  source: /note="Description of Artificial Sequence: Synthetic oligonucleotide"
auuauguuuuacgggucuua

SEQ ID NO: 9075 - RNA, 20 nt, Artificial Sequence
  source: /note="Description of Artificial Sequence: Synthetic oligonucleotide"
uacuuucuucggucucucuu

SEQ ID NO: 9076 - RNA, 20 nt, Artificial Sequence
  source: /note="Description of Artificial Sequence: Synthetic oligonucleotide"
uuacucugaacuuuuguaac

SEQ ID NO: 9077 - RNA, 20 nt, Artificial Sequence
  source: /note="Description of Artificial Sequence: Synthetic oligonucleotide"
uuuuuuuucuuuuucuuuuu

SEQ ID NO: 9078 - RNA, 20 nt, Artificial Sequence
  source: /note="Description of Artificial Sequence: Synthetic oligonucleotide"
uacaccacacuuauauaugc

SEQ ID NO: 9079 - RNA, 20 nt, Artificial Sequence
  source: /note="Description of Artificial Sequence: Synthetic oligonucleotide"
ucugagacagaguuuuuuac

SEQ ID NO: 9080 - RNA, 20 nt, Artificial Sequence
  source: /note="Description of Artificial Sequence: Synthetic oligonucleotide"
cgugguaacgugggaucgga

SEQ ID NO: 9081 - RNA, 20 nt, Artificial Sequence
  source: /note="Description of Artificial Sequence: Synthetic oligonucleotide"
acgugguaacgugggaucgg

SEQ ID NO: 9082 - RNA, 20 nt, Artificial Sequence
  source: /note="Description of Artificial Sequence: Synthetic oligonucleotide"
ugucuccaacgucacucgac

SEQ ID NO: 9083 - RNA, 20 nt, Artificial Sequence
  source: /note="Description of Artificial Sequence: Synthetic oligonucleotide"
gugaacuugggcccucuguc

SEQ ID NO: 9084 - RNA, 20 nt, Artificial Sequence
  source: /note="Description of Artificial Sequence: Synthetic oligonucleotide"
guacucuuagugaacuuggg

SEQ ID NO: 9085 - RNA, 20 nt, Artificial Sequence
  source: /note="Description of Artificial Sequence: Synthetic oligonucleotide"
cguacucuuagugaacuugg

SEQ ID NO: 9086 - RNA, 20 nt, Artificial Sequence
  source: /note="Description of Artificial Sequence: Synthetic oligonucleotide"
aggguugaugaacccccgac

SEQ ID NO: 9087 - RNA, 20 nt, Artificial Sequence
  source: /note="Description of Artificial Sequence: Synthetic oligonucleotide"
gacauuaggguugaugaacc

SEQ ID NO: 9088 - RNA, 20 nt, Artificial Sequence
  source: /note="Description of Artificial Sequence: Synthetic oligonucleotide"
ugacauuaggguugaugaac

SEQ ID NO: 9089 - RNA, 20 nt, Artificial Sequence
  source: /note="Description of Artificial Sequence: Synthetic oligonucleotide"
uugacauuaggguugaugaa

SEQ ID NO: 9090 - RNA, 20 nt, Artificial Sequence
  source: /note="Description of Artificial Sequence: Synthetic oligonucleotide"
guugacauuaggguugauga

SEQ ID NO: 9091 - RNA, 20 nt, Artificial Sequence
  source: /note="Description of Artificial Sequence: Synthetic oligonucleotide"
guuuuuaaucgacccacacc

SEQ ID NO: 9092 - RNA, 20 nt, Artificial Sequence
  source: /note="Description of Artificial Sequence: Synthetic oligonucleotide"
uauguuuuuaaucgacccac

SEQ ID NO: 9093 - RNA, 20 nt, Artificial Sequence
  source: /note="Description of Artificial Sequence: Synthetic oligonucleotide"
auuuuuauguuuuuaaucga

SEQ ID NO: 9094 - RNA, 20 nt, Artificial Sequence
  source: /note="Description of Artificial Sequence: Synthetic oligonucleotide"
gauuuuuauguuuuuaaucg

SEQ ID NO: 9095 - RNA, 20 nt, Artificial Sequence
  source: /note="Description of Artificial Sequence: Synthetic oligonucleotide"
acucuggucggaucgguugu

SEQ ID NO: 9096 - RNA, 20 nt, Artificial Sequence
  source: /note="Description of Artificial Sequence: Synthetic oligonucleotide"
auuccaucuuccuagugaac

SEQ ID NO: 9097 - RNA, 20 nt, Artificial Sequence
  source: /note="Description of Artificial Sequence: Synthetic oligonucleotide"
gaaauccuccgauuccaucu

SEQ ID NO: 9098 - RNA, 20 nt, Artificial Sequence
  source: /note="Description of Artificial Sequence: Synthetic oligonucleotide"
gggucgugaaauccuccgau

SEQ ID NO: 9099 - RNA, 20 nt, Artificial Sequence
  source: /note="Description of Artificial Sequence: Synthetic oligonucleotide"
acauuagggucgugaaaucc

SEQ ID NO: 9100 - RNA, 20 nt, Artificial Sequence
  source: /note="Description of Artificial Sequence: Synthetic oligonucleotide"
cgaacauuagggucgugaaa

SEQ ID NO: 9101 - RNA, 20 nt, Artificial Sequence
  source: /note="Description of Artificial Sequence: Synthetic oligonucleotide"
cuuuuacaccgacccguguc

SEQ ID NO: 9102 - RNA, 20 nt, Artificial Sequence
  source: /note="Description of Artificial Sequence: Synthetic oligonucleotide"
accuuuuucuuuuacaccga

SEQ ID NO: 9103 - RNA, 20 nt, Artificial Sequence
  source: /note="Description of Artificial Sequence: Synthetic oligonucleotide"
uaccuuuuucuuuuacaccg

SEQ ID NO: 9104 - RNA, 20 nt, Artificial Sequence
  source: /note="Description of Artificial Sequence: Synthetic oligonucleotide"
uauuuaccuuuuucuuuuac

SEQ ID NO: 9105 - RNA, 20 nt, Artificial Sequence
  source: /note="Description of Artificial Sequence: Synthetic oligonucleotide"
uuacaguuaauugauuauuu

SEQ ID NO: 9106 - RNA, 20 nt, Artificial Sequence
  source: /note="Description of Artificial Sequence: Synthetic oligonucleotide"
ugaggauccacauauagggu

SEQ ID NO: 9107 - RNA, 20 nt, Artificial Sequence
  source: /note="Description of Artificial Sequence: Synthetic oligonucleotide"
aaugauuguuacagugagga

SEQ ID NO: 9108 - RNA, 20 nt, Artificial Sequence
  source: /note="Description of Artificial Sequence: Synthetic oligonucleotide"
ucgaugaaaccuuuugucaa

SEQ ID NO: 9109 - RNA, 20 nt, Artificial Sequence
  source: /note="Description of Artificial Sequence: Synthetic oligonucleotide"
cauuuucguauuucgaugaa

SEQ ID NO: 9110 - RNA, 20 nt, Artificial Sequence
  source: /note="Description of Artificial Sequence: Synthetic oligonucleotide"
gaccuuggaaguauguaaca

SEQ ID NO: 9111 - RNA, 20 nt, Artificial Sequence
  source: /note="Description of Artificial Sequence: Synthetic oligonucleotide"
aacuccuacaccucuaugug

SEQ ID NO: 9112 - RNA, 20 nt, Artificial Sequence
  source: /note="Description of Artificial Sequence: Synthetic oligonucleotide"
uauuguaaaagaacuccuac

SEQ ID NO: 9113 - RNA, 20 nt, Artificial Sequence
  source: /note="Description of Artificial Sequence: Synthetic oligonucleotide"
uucuguuauuguaaaagaac

SEQ ID NO: 9114 - RNA, 20 nt, Artificial Sequence
  source: /note="Description of Artificial Sequence: Synthetic oligonucleotide"
uuugaaguaugggugaaccu

SEQ ID NO: 9115 - RNA, 20 nt, Artificial Sequence
  source: /note="Description of Artificial Sequence: Synthetic oligonucleotide"
ucuauuugaaguauggguga

SEQ ID NO: 9116 - RNA, 20 nt, Artificial Sequence
  source: /note="Description of Artificial Sequence: Synthetic oligonucleotide"
cuacggguuauagucgguaa

SEQ ID NO: 9117 - RNA, 20 nt, Artificial Sequence
  source: /note="Description of Artificial Sequence: Synthetic oligonucleotide"
ugaaaagaguuuuuuuaugu

SEQ ID NO: 9118 - RNA, 20 nt, Artificial Sequence
  source: /note="Description of Artificial Sequence: Synthetic oligonucleotide"
ccucuuuuauagacguuugg

SEQ ID NO: 9119 - RNA, 20 nt, Artificial Sequence
  source: /note="Description of Artificial Sequence: Synthetic oligonucleotide"
cuucgcuguuggacacccua

SEQ ID NO: 9120 - RNA, 20 nt, Artificial Sequence
  source: /note="Description of Artificial Sequence: Synthetic oligonucleotide"
uuucacuucgcuguuggaca

SEQ ID NO: 9121 - RNA, 20 nt, Artificial Sequence
  source: /note="Description of Artificial Sequence: Synthetic oligonucleotide"
guuucacuucgcuguuggac

SEQ ID NO: 9122 - RNA, 20 nt, Artificial Sequence
  source: /note="Description of Artificial Sequence: Synthetic oligonucleotide"
aaauuuugaaaacaugaaau

SEQ ID NO: 9123 - RNA, 20 nt, Artificial Sequence
  source: /note="Description of Artificial Sequence: Synthetic oligonucleotide"
uuagaaagucuagaacuuac

SEQ ID NO: 9124 - RNA, 20 nt, Artificial Sequence
  source: /note="Description of Artificial Sequence: Synthetic oligonucleotide"
uaugagacucuucuuucgua

SEQ ID NO: 9125 - RNA, 20 nt, Artificial Sequence
  source: /note="Description of Artificial Sequence: Synthetic oligonucleotide"
augaacguuuccuuacuuca

SEQ ID NO: 9126 - RNA, 20 nt, Artificial Sequence
  source: /note="Description of Artificial Sequence: Synthetic oligonucleotide"
uugaccugucgaugaacguu

SEQ ID NO: 9127 - RNA, 20 nt, Artificial Sequence
  source: /note="Description of Artificial Sequence: Synthetic oligonucleotide"
uguuuaccacgacucuuuug

SEQ ID NO: 9128 - RNA, 20 nt, Artificial Sequence
  source: /note="Description of Artificial Sequence: Synthetic oligonucleotide"
uuuuugucagaaaauuguuu

SEQ ID NO: 9129 - RNA, 20 nt, Artificial Sequence
  source: /note="Description of Artificial Sequence: Synthetic oligonucleotide"
ucuuuauuuggguauguaga

SEQ ID NO: 9130 - RNA, 20 nt, Artificial Sequence
  source: /note="Description of Artificial Sequence: Synthetic oligonucleotide"
cuuagucgugucacaccaug

SEQ ID NO: 9131 - RNA, 20 nt, Artificial Sequence
  source: /note="Description of Artificial Sequence: Synthetic oligonucleotide"
gauguccuuagucgugucac

SEQ ID NO: 9132 - RNA, 20 nt, Artificial Sequence
  source: /note="Description of Artificial Sequence: Synthetic oligonucleotide"
uuuuaaaugauguuuugaug

SEQ ID NO: 9133 - RNA, 20 nt, Artificial Sequence
  source: /note="Description of Artificial Sequence: Synthetic oligonucleotide"
ccauccguuuucauguuuca

SEQ ID NO: 9134 - RNA, 20 nt, Artificial Sequence
  source: /note="Description of Artificial Sequence: Synthetic oligonucleotide"
ccuuuggguucuuuguacca

SEQ ID NO: 9135 - RNA, 20 nt, Artificial Sequence
  source: /note="Description of Artificial Sequence: Synthetic oligonucleotide"
uauaccuuuggguucuuugu

SEQ ID NO: 9136 - RNA, 20 nt, Artificial Sequence
  source: /note="Description of Artificial Sequence: Synthetic oligonucleotide"
ucgacuagaauuuuacguau

SEQ ID NO: 9137 - RNA, 20 nt, Artificial Sequence
  source: /note="Description of Artificial Sequence: Synthetic oligonucleotide"
uuuuuuuaggucuuuccuuu

SEQ ID NO: 9138 - RNA, 20 nt, Artificial Sequence
  source: /note="Description of Artificial Sequence: Synthetic oligonucleotide"
uuuuuuuuuuuuuaggucuu

SEQ ID NO: 9139 - RNA, 20 nt, Artificial Sequence
  source: /note="Description of Artificial Sequence: Synthetic oligonucleotide"
guccucaaguuuuggucgaa

SEQ ID NO: 9140 - RNA, 20 nt, Artificial Sequence
  source: /note="Description of Artificial Sequence: Synthetic oligonucleotide"
gguccucaaguuuuggucga

SEQ ID NO: 9141 - RNA, 20 nt, Artificial Sequence
  source: /note="Description of Artificial Sequence: Synthetic oligonucleotide"
cucccuccuagagaaaucgg

SEQ ID NO: 9142 - RNA, 20 nt, Artificial Sequence
  source: /note="Description of Artificial Sequence: Synthetic oligonucleotide"
gagacccuucggauccuccc

SEQ ID NO: 9143 - RNA, 20 nt, Artificial Sequence
  source: /note="Description of Artificial Sequence: Synthetic oligonucleotide"
cgagagacccuucggauccu

SEQ ID NO: 9144 - RNA, 20 nt, Artificial Sequence
  source: /note="Description of Artificial Sequence: Synthetic oligonucleotide"
ucgagagacccuucggaucc

SEQ ID NO: 9145 - RNA, 20 nt, Artificial Sequence
  source: /note="Description of Artificial Sequence: Synthetic oligonucleotide"
gggucgagagacccuucgga

SEQ ID NO: 9146 - RNA, 20 nt, Artificial Sequence
  source: /note="Description of Artificial Sequence: Synthetic oligonucleotide"
cggacauuggggucgagaga

SEQ ID NO: 9147 - RNA, 20 nt, Artificial Sequence
  source: /note="Description of Artificial Sequence: Synthetic oligonucleotide"
acggacauuggggucgagag

SEQ ID NO: 9148 - RNA, 20 nt, Artificial Sequence
  source: /note="Description of Artificial Sequence: Synthetic oligonucleotide"
gucuucccccaaccuacacc

SEQ ID NO: 9149 - RNA, 20 nt, Artificial Sequence
  source: /note="Description of Artificial Sequence: Synthetic oligonucleotide"
agggucuucccccaaccuac

SEQ ID NO: 9150 - RNA, 20 nt, Artificial Sequence
  source: /note="Description of Artificial Sequence: Synthetic oligonucleotide"
aguuucagggucuuccccca

SEQ ID NO: 9151 - RNA, 20 nt, Artificial Sequence
  source: /note="Description of Artificial Sequence: Synthetic oligonucleotide"
ggucaguuucagggucuucc

SEQ ID NO: 9152 - RNA, 20 nt, Artificial Sequence
  source: /note="Description of Artificial Sequence: Synthetic oligonucleotide"
gggucaguuucagggucuuc

SEQ ID NO: 9153 - RNA, 20 nt, Artificial Sequence
  source: /note="Description of Artificial Sequence: Synthetic oligonucleotide"
ggggucaguuucagggucuu

SEQ ID NO: 9154 - RNA, 20 nt, Artificial Sequence
  source: /note="Description of Artificial Sequence: Synthetic oligonucleotide"
uggggucaguuucagggucu

SEQ ID NO: 9155 - RNA, 20 nt, Artificial Sequence
  source: /note="Description of Artificial Sequence: Synthetic oligonucleotide"
uuaucggacacaaguauuua

SEQ ID NO: 9156 - RNA, 20 nt, Artificial Sequence
  source: /note="Description of Artificial Sequence: Synthetic oligonucleotide"
cuuucuuuaaauucuuauuu

SEQ ID NO: 9157 - RNA, 20 nt, Artificial Sequence
  source: /note="Description of Artificial Sequence: Synthetic oligonucleotide"
aauuuuuuuuauuuuucacg

SEQ ID NO: 9158 - RNA, 20 nt, Artificial Sequence
  source: /note="Description of Artificial Sequence: Synthetic oligonucleotide"
cgucgugacgugagaccuga

SEQ ID NO: 9159 - RNA, 20 nt, Artificial Sequence
  source: /note="Description of Artificial Sequence: Synthetic oligonucleotide"
ccgucgugacgugagaccug

SEQ ID NO: 9160 - RNA, 20 nt, Artificial Sequence
  source: /note="Description of Artificial Sequence: Synthetic oligonucleotide"
cucuaccgucgugacgugag

SEQ ID NO: 9161 - RNA, 20 nt, Artificial Sequence
  source: /note="Description of Artificial Sequence: Synthetic oligonucleotide"
cuccaacgucacucgacucu

SEQ ID NO: 9162 - RNA, 20 nt, Artificial Sequence
  source: /note="Description of Artificial Sequence: Synthetic oligonucleotide"
agugaacuugggccuccacc

SEQ ID NO: 9163 - RNA, 20 nt, Artificial Sequence
  source: /note="Description of Artificial Sequence: Synthetic oligonucleotide"
cuuagugaacuugggccucc

SEQ ID NO: 9164 - RNA, 20 nt, Artificial Sequence
  source: /note="Description of Artificial Sequence: Synthetic oligonucleotide"
ccucuuagugaacuugggcc

SEQ ID NO: 9165 - RNA, 20 nt, Artificial Sequence
  source: /note="Description of Artificial Sequence: Synthetic oligonucleotide"
cguccucuuagugaacuugg

SEQ ID NO: 9166 - RNA, 20 nt, Artificial Sequence
  source: /note="Description of Artificial Sequence: Synthetic oligonucleotide"
ggacaucaaggucgacuccg

SEQ ID NO: 9167 - RNA, 20 nt, Artificial Sequence
  source: /note="Description of Artificial Sequence: Synthetic oligonucleotide"
gcguggacaucaaggucgac

SEQ ID NO: 9168 - RNA, 20 nt, Artificial Sequence
  source: /note="Description of Artificial Sequence: Synthetic oligonucleotide"
uuuguuaaucgguccguacc

SEQ ID NO: 9169 - RNA, 20 nt, Artificial Sequence
  source: /note="Description of Artificial Sequence: Synthetic oligonucleotide"
uguuuuguuaaucgguccgu

SEQ ID NO: 9170 - RNA, 20 nt, Artificial Sequence
  source: /note="Description of Artificial Sequence: Synthetic oligonucleotide"
uuuuguguuuuguuaaucgg

SEQ ID NO: 9171 - RNA, 20 nt, Artificial Sequence
  source: /note="Description of Artificial Sequence: Synthetic oligonucleotide"
acucuggucggaccgguugu

SEQ ID NO: 9172 - RNA, 20 nt, Artificial Sequence
  source: /note="Description of Artificial Sequence: Synthetic oligonucleotide"
gguccacaaacucuggucgg

SEQ ID NO: 9173 - RNA, 20 nt, Artificial Sequence
  source: /note="Description of Artificial Sequence: Synthetic oligonucleotide"
gucaguccagugaacuccgg

SEQ ID NO: 9174 - RNA, 20 nt, Artificial Sequence
  source: /note="Description of Artificial Sequence: Synthetic oligonucleotide"
guuccgucaguccagugaac

SEQ ID NO: 9175 - RNA, 20 nt, Artificial Sequence
  source: /note="Description of Artificial Sequence: Synthetic oligonucleotide"
aaacccuccgguuccgucag

SEQ ID NO: 9176 - RNA, 20 nt, Artificial Sequence
  source: /note="Description of Artificial Sequence: Synthetic oligonucleotide"
gggucaugaaacccuccggu

SEQ ID NO: 9177 - RNA, 20 nt, Artificial Sequence
  source: /note="Description of Artificial Sequence: Synthetic oligonucleotide"
acauuagggucaugaaaccc

SEQ ID NO: 9178 - RNA, 20 nt, Artificial Sequence
  source: /note="Description of Artificial Sequence: Synthetic oligonucleotide"
cggacauuagggucaugaaa

SEQ ID NO: 9179 - RNA, 20 nt, Artificial Sequence
  source: /note="Description of Artificial Sequence: Synthetic oligonucleotide"
acggacauuagggucaugaa

SEQ ID NO: 9180 - RNA, 20 nt, Artificial Sequence
  source: /note="Description of Artificial Sequence: Synthetic oligonucleotide"
cuucauguccgguccgcacc

SEQ ID NO: 9181 - RNA, 20 nt, Artificial Sequence
  source: /note="Description of Artificial Sequence: Synthetic oligonucleotide"
ugucuucauguccgguccgc

SEQ ID NO: 9182 - RNA, 20 nt, Artificial Sequence
  source: /note="Description of Artificial Sequence: Synthetic oligonucleotide"
aaaauugucuucauguccgg

SEQ ID NO: 9183 - RNA, 20 nt, Artificial Sequence
  source: /note="Description of Artificial Sequence: Synthetic oligonucleotide"
uuuuuaaaauugucuucaug

SEQ ID NO: 9184 - RNA, 20 nt, Artificial Sequence
  source: /note="Description of Artificial Sequence: Synthetic oligonucleotide"
uuuuuuaaacuaaaacguua

SEQ ID NO: 9185 - RNA, 20 nt, Artificial Sequence
  source: /note="Description of Artificial Sequence: Synthetic oligonucleotide"
ucgaucaagucguucaacca

SEQ ID NO: 9186 - RNA, 20 nt, Artificial Sequence
  source: /note="Description of Artificial Sequence: Synthetic oligonucleotide"
uuauucgaucaagucguuca

SEQ ID NO: 9187 - RNA, 20 nt, Artificial Sequence
  source: /note="Description of Artificial Sequence: Synthetic oligonucleotide"
gaacauacgucguuuaggau

SEQ ID NO: 9188 - RNA, 20 nt, Artificial Sequence
  source: /note="Description of Artificial Sequence: Synthetic oligonucleotide"
uuuguauuucggugggucua

SEQ ID NO: 9189 - RNA, 20 nt, Artificial Sequence
  source: /note="Description of Artificial Sequence: Synthetic oligonucleotide"
cuucaagauugacccauuag

SEQ ID NO: 9190 - RNA, 20 nt, Artificial Sequence
  source: /note="Description of Artificial Sequence: Synthetic oligonucleotide"
uaaaagaccuucaagauuga

SEQ ID NO: 9191 - RNA, 20 nt, Artificial Sequence
  source: /note="Description of Artificial Sequence: Synthetic oligonucleotide"
guaaaagaccuucaagauug

SEQ ID NO: 9192 - RNA, 20 nt, Artificial Sequence
  source: /note="Description of Artificial Sequence: Synthetic oligonucleotide"
auuaacauggacuguaaaag

SEQ ID NO: 9193 - RNA, 20 nt, Artificial Sequence
  source: /note="Description of Artificial Sequence: Synthetic oligonucleotide"
aaagauuuuacuuauucugu

SEQ ID NO: 9194 - RNA, 20 nt, Artificial Sequence
  source: /note="Description of Artificial Sequence: Synthetic oligonucleotide"
uguugaucauaguaugaauu

SEQ ID NO: 9195 - RNA, 20 nt, Artificial Sequence
  source: /note="Description of Artificial Sequence: Synthetic oligonucleotide"
aguuguuugaucguugucuu

SEQ ID NO: 9196 - RNA, 20 nt, Artificial Sequence
  source: /note="Description of Artificial Sequence: Synthetic oligonucleotide"
aaguuguuugaucguugucu

SEQ ID NO: 9197 - RNA, 20 nt, Artificial Sequence
  source: /note="Description of Artificial Sequence: Synthetic oligonucleotide"
uaugguauaauuaucuuauu

SEQ ID NO: 9198 - RNA, 20 nt, Artificial Sequence
  source: /note="Description of Artificial Sequence: Synthetic oligonucleotide"
uuaugugugacuccgguuca

SEQ ID NO: 9199 - RNA, 20 nt, Artificial Sequence
  source: /note="Description of Artificial Sequence: Synthetic oligonucleotide"
auuaugugugacuccgguuc

SEQ ID NO: 9200 - RNA, 20 nt, Artificial Sequence
  source: /note="Description of Artificial Sequence: Synthetic oligonucleotide"
uauuuuucauuaugugugac

SEQ ID NO: 9201 - RNA, 20 nt, Artificial Sequence
  source: /note="Description of Artificial Sequence: Synthetic oligonucleotide"
gagaagguuuucuaucucuu

SEQ ID NO: 9202 - RNA, 20 nt, Artificial Sequence
  source: /note="Description of Artificial Sequence: Synthetic oligonucleotide"
ugagaagguuuucuaucucu

SEQ ID NO: 9203 - RNA, 20 nt, Artificial Sequence
  source: /note="Description of Artificial Sequence: Synthetic oligonucleotide"
aggguguuuccuuucggguc

SEQ ID NO: 9204 - RNA, 20 nt, Artificial Sequence
  source: /note="Description of Artificial Sequence: Synthetic oligonucleotide"
aaggguguuuccuuucgggu

SEQ ID NO: 9205 - RNA, 20 nt, Artificial Sequence
  source: /note="Description of Artificial Sequence: Synthetic oligonucleotide"
uaaggguguuuccuuucggg

SEQ ID NO: 9206 - RNA, 20 nt, Artificial Sequence
  source: /note="Description of Artificial Sequence: Synthetic oligonucleotide"
auguuuuuuuuaaggguguu

SEQ ID NO: 9207 - RNA, 20 nt, Artificial Sequence
  source: /note="Description of Artificial Sequence: Synthetic oligonucleotide"
uguccccgucguacaugaau

SEQ ID NO: 9208 - RNA, 20 nt, Artificial Sequence
  source: /note="Description of Artificial Sequence: Synthetic oligonucleotide"
cccuccgauacguguauguc

SEQ ID NO: 9209 - RNA, 20 nt, Artificial Sequence
  source: /note="Description of Artificial Sequence: Synthetic oligonucleotide"
ucccuccgauacguguaugu

SEQ ID NO: 9210 - RNA, 20 nt, Artificial Sequence
  source: /note="Description of Artificial Sequence: Synthetic oligonucleotide"
cucccuccgauacguguaug

SEQ ID NO: 9211 - RNA, 20 nt, Artificial Sequence
  source: /note="Description of Artificial Sequence: Synthetic oligonucleotide"
uuccuacaacuauuacuccc

SEQ ID NO: 9212 - RNA, 20 nt, Artificial Sequence
  source: /note="Description of Artificial Sequence: Synthetic oligonucleotide"
cauuuccuacaacuauuacu

SEQ ID NO: 9213 - RNA, 20 nt, Artificial Sequence
  source: /note="Description of Artificial Sequence: Synthetic oligonucleotide"
ccauuuccuacaacuauuac

SEQ ID NO: 9214 - RNA, 20 nt, Artificial Sequence
  source: /note="Description of Artificial Sequence: Synthetic oligonucleotide"
guuuacaugguaagaccauu

SEQ ID NO: 9215 - RNA, 20 nt, Artificial Sequence
  source: /note="Description of Artificial Sequence: Synthetic oligonucleotide"
gacguuguuuacaugguaag

SEQ ID NO: 9216 - RNA, 20 nt, Artificial Sequence
  source: /note="Description of Artificial Sequence: Synthetic oligonucleotide"
aguagcuguuaacaguuacg

SEQ ID NO: 9217 - RNA, 20 nt, Artificial Sequence
  source: /note="Description of Artificial Sequence: Synthetic oligonucleotide"
gugucuuauguauugugguu

SEQ ID NO: 9218 - RNA, 20 nt, Artificial Sequence
  source: /note="Description of Artificial Sequence: Synthetic oligonucleotide"
acuuacucauaguaauuugu

SEQ ID NO: 9219 - RNA, 20 nt, Artificial Sequence
  source: /note="Description of Artificial Sequence: Synthetic oligonucleotide"
augagacuuacuaugacauu

SEQ ID NO: 9220 - RNA, 20 nt, Artificial Sequence
  source: /note="Description of Artificial Sequence: Synthetic oligonucleotide"
aucccaugucuccugaaaau

SEQ ID NO: 9221 - RNA, 20 nt, Artificial Sequence
  source: /note="Description of Artificial Sequence: Synthetic oligonucleotide"
cuuuuuauccaucccauguc

SEQ ID NO: 9222 - RNA, 20 nt, Artificial Sequence
  source: /note="Description of Artificial Sequence: Synthetic oligonucleotide"
cauccucucuuuuuauccau

SEQ ID NO: 9223 - RNA, 20 nt, Artificial Sequence
  source: /note="Description of Artificial Sequence: Synthetic oligonucleotide"
ccauccucucuuuuuaucca

SEQ ID NO: 9224 - RNA, 20 nt, Artificial Sequence
  source: /note="Description of Artificial Sequence: Synthetic oligonucleotide"
caccccauccucucuuuuua

SEQ ID NO: 9225 - RNA, 20 nt, Artificial Sequence
  source: /note="Description of Artificial Sequence: Synthetic oligonucleotide"
aacgauucccaaucacccca

SEQ ID NO: 9226 - RNA, 20 nt, Artificial Sequence
  source: /note="Description of Artificial Sequence: Synthetic oligonucleotide"
aaccaacgauucccaaucac

SEQ ID NO: 9227 - RNA, 20 nt, Artificial Sequence
  source: /note="Description of Artificial Sequence: Synthetic oligonucleotide"
uaaccaacgauucccaauca

SEQ ID NO: 9228 - RNA, 20 nt, Artificial Sequence
  source: /note="Description of Artificial Sequence: Synthetic oligonucleotide"
guaaccaacgauucccaauc

SEQ ID NO: 9229 - RNA, 20 nt, Artificial Sequence
  source: /note="Description of Artificial Sequence: Synthetic oligonucleotide"
uuuucuaguaaccaacgauu

SEQ ID NO: 9230 - RNA, 20 nt, Artificial Sequence
  source: /note="Description of Artificial Sequence: Synthetic oligonucleotide"
uuuuucuaguaaccaacgau

SEQ ID NO: 9231 - RNA, 20 nt, Artificial Sequence
  source: /note="Description of Artificial Sequence: Synthetic oligonucleotide"
auaacucuauuuuucuagua

SEQ ID NO: 9232 - RNA, 20 nt, Artificial Sequence
  source: /note="Description of Artificial Sequence: Synthetic oligonucleotide"
ugauauacuguaagaccuua

SEQ ID NO: 9233 - RNA, 20 nt, Artificial Sequence
  source: /note="Description of Artificial Sequence: Synthetic oligonucleotide"
uaagguugauauacuguaag

SEQ ID NO: 9234 - RNA, 20 nt, Artificial Sequence
  source: /note="Description of Artificial Sequence: Synthetic oligonucleotide"
acuguuuuuggucagacuuu

SEQ ID NO: 9235 - RNA, 20 nt, Artificial Sequence
  source: /note="Description of Artificial Sequence: Synthetic oligonucleotide"
uuacuugcuaguacuguacc

SEQ ID NO: 9236 - RNA, 20 nt, Artificial Sequence
  source: /note="Description of Artificial Sequence: Synthetic oligonucleotide"
ucuuuacuugcuaguacugu

SEQ ID NO: 9237 - RNA, 20 nt, Artificial Sequence
  source: /note="Description of Artificial Sequence: Synthetic oligonucleotide"
uugacacuauuuggucuguu

SEQ ID NO: 9238 - RNA, 20 nt, Artificial Sequence
  source: /note="Description of Artificial Sequence: Synthetic oligonucleotide"
cuacagaaagugauacacuu

SEQ ID NO: 9239 - RNA, 20 nt, Artificial Sequence
  source: /note="Description of Artificial Sequence: Synthetic oligonucleotide"
auaaguauuaacaguuuuga

SEQ ID NO: 9240 - RNA, 20 nt, Artificial Sequence
  source: /note="Description of Artificial Sequence: Synthetic oligonucleotide"
cgagacacaauaaaugaguu

SEQ ID NO: 9241 - RNA, 20 nt, Artificial Sequence
  source: /note="Description of Artificial Sequence: Synthetic oligonucleotide"
gaaagacaaacaagacguuu

SEQ ID NO: 9242 - RNA, 20 nt, Artificial Sequence
  source: /note="Description of Artificial Sequence: Synthetic oligonucleotide"
ugucuuguauaucuacugga

SEQ ID NO: 9243 - RNA, 20 nt, Artificial Sequence
  source: /note="Description of Artificial Sequence: Synthetic oligonucleotide"
uacgucuugauauuuuaaag

SEQ ID NO: 9244 - RNA, 20 nt, Artificial Sequence
  source: /note="Description of Artificial Sequence: Synthetic oligonucleotide"
aacguuuuaauuacguuuua

SEQ ID NO: 9245 - RNA, 20 nt, Artificial Sequence
  source: /note="Description of Artificial Sequence: Synthetic oligonucleotide"
aaacguuuuaauuacguuuu

SEQ ID NO: 9246 - RNA, 20 nt, Artificial Sequence
  source: /note="Description of Artificial Sequence: Synthetic oligonucleotide"
ucuuuaccaugcccuuguug

SEQ ID NO: 9247 - RNA, 20 nt, Artificial Sequence
  source: /note="Description of Artificial Sequence: Synthetic oligonucleotide"
aucagaaauucuuuaccaug

SEQ ID NO: 9248 - RNA, 20 nt, Artificial Sequence
  source: /note="Description of Artificial Sequence: Synthetic oligonucleotide"
uaucagaaauucuuuaccau

SEQ ID NO: 9249 - RNA, 20 nt, Artificial Sequence
  source: /note="Description of Artificial Sequence: Synthetic oligonucleotide"
guuucuaucagaaauucuuu

SEQ ID NO: 9250 - RNA, 20 nt, Artificial Sequence
  source: /note="Description of Artificial Sequence: Synthetic oligonucleotide"
cuagaaacuguuucaucguu

SEQ ID NO: 9251 - RNA, 20 nt, Artificial Sequence
  source: /note="Description of Artificial Sequence: Synthetic oligonucleotide"
ucagaucuguuuauauaguu

SEQ ID NO: 9252 - RNA, 20 nt, Artificial Sequence
  source: /note="Description of Artificial Sequence: Synthetic oligonucleotide"
aauuguucuaucacaccaua

SEQ ID NO: 9253 - RNA, 20 nt, Artificial Sequence
  source: /note="Description of Artificial Sequence: Synthetic oligonucleotide"
ggauucaauuguucuaucac

SEQ ID NO: 9254 - RNA, 20 nt, Artificial Sequence
  source: /note="Description of Artificial Sequence: Synthetic oligonucleotide"
uuccucuuuuuguuacaguc

SEQ ID NO: 9255 - RNA, 20 nt, Artificial Sequence
  source: /note="Description of Artificial Sequence: Synthetic oligonucleotide"
uuaucgguugaguuaugacu

SEQ ID NO: 9256 - RNA, 20 nt, Artificial Sequence
  source: /note="Description of Artificial Sequence: Synthetic oligonucleotide"
acgaaaaaaaugaaucauua

SEQ ID NO: 9257 - RNA, 20 nt, Artificial Sequence
  source: /note="Description of Artificial Sequence: Synthetic oligonucleotide"
uaaaauuucaaauauaguuc

SEQ ID NO: 9258 - RNA, 20 nt, Artificial Sequence
  source: /note="Description of Artificial Sequence: Synthetic oligonucleotide"
uuuuaaggacguucuaaaac

SEQ ID NO: 9259 - RNA, 20 nt, Artificial Sequence
  source: /note="Description of Artificial Sequence: Synthetic oligonucleotide"
cuucuacacauaacaguucu

SEQ ID NO: 9260 - RNA, 20 nt, Artificial Sequence
  source: /note="Description of Artificial Sequence: Synthetic oligonucleotide"
cuacaagguacaaguaccua

SEQ ID NO: 9261 - RNA, 20 nt, Artificial Sequence
  source: /note="Description of Artificial Sequence: Synthetic oligonucleotide"
uuucucuacaagguacaagu

SEQ ID NO: 9262 - RNA, 20 nt, Artificial Sequence
  source: /note="Description of Artificial Sequence: Synthetic oligonucleotide"
uuuuacguuuuaagauuacu

SEQ ID NO: 9263 - RNA, 20 nt, Artificial Sequence
  source: /note="Description of Artificial Sequence: Synthetic oligonucleotide"
uauacauguaccagauauac

SEQ ID NO: 9264 - RNA, 20 nt, Artificial Sequence
  source: /note="Description of Artificial Sequence: Synthetic oligonucleotide"
uuauacauguaccagauaua

SEQ ID NO: 9265 - RNA, 20 nt, Artificial Sequence
  source: /note="Description of Artificial Sequence: Synthetic oligonucleotide"
auuauacauguaccagauau

SEQ ID NO: 9266 - RNA, 20 nt, Artificial Sequence
  source: /note="Description of Artificial Sequence: Synthetic oligonucleotide"
cauauuuagauuauacaugu

SEQ ID NO: 9267 - RNA, 20 nt, Artificial Sequence
  source: /note="Description of Artificial Sequence: Synthetic oligonucleotide"
acuaauauauuguaccaacg

SEQ ID NO: 9268 - RNA, 20 nt, Artificial Sequence
  source: /note="Description of Artificial Sequence: Synthetic oligonucleotide"
agauuucacuaauauauugu

SEQ ID NO: 9269 - RNA, 20 nt, Artificial Sequence
  source: /note="Description of Artificial Sequence: Synthetic oligonucleotide"
uacugguuuuuuuuuuuuug

SEQ ID NO: 9270 - RNA, 20 nt, Artificial Sequence
  source: /note="Description of Artificial Sequence: Synthetic oligonucleotide"
guaauucuguucuuuuauuu

SEQ ID NO: 9271 - RNA, 20 nt, Artificial Sequence
  source: /note="Description of Artificial Sequence: Synthetic oligonucleotide"
uuacggaaaguuguaguaug

SEQ ID NO: 9272 - RNA, 20 nt, Artificial Sequence
  source: /note="Description of Artificial Sequence: Synthetic oligonucleotide"
aggacgacucuaguccuugu

SEQ ID NO: 9273 - RNA, 20 nt, Artificial Sequence
  source: /note="Description of Artificial Sequence: Synthetic oligonucleotide"
cuucuaaaggacgacucuag

SEQ ID NO: 9274 - RNA, 20 nt, Artificial Sequence
  source: /note="Description of Artificial Sequence: Synthetic oligonucleotide"
agucauuugauccuuuucuc

SEQ ID NO: 9275 - RNA, 20 nt, Artificial Sequence
  source: /note="Description of Artificial Sequence: Synthetic oligonucleotide"
gagucauuugauccuuuucu

SEQ ID NO: 9276 - RNA, 20 nt, Artificial Sequence
  source: /note="Description of Artificial Sequence: Synthetic oligonucleotide"
agagucauuugauccuuuuc

SEQ ID NO: 9277 - RNA, 20 nt, Artificial Sequence
  source: /note="Description of Artificial Sequence: Synthetic oligonucleotide"
guuuucggagagucauuuga

SEQ ID NO: 9278 - RNA, 20 nt, Artificial Sequence
  source: /note="Description of Artificial Sequence: Synthetic oligonucleotide"
guauaccauuauaguuaucc

SEQ ID NO: 9279 - RNA, 20 nt, Artificial Sequence
  source: /note="Description of Artificial Sequence: Synthetic oligonucleotide"
uuaguauaccauuauaguua

SEQ ID NO: 9280 - RNA, 20 nt, Artificial Sequence
  source: /note="Description of Artificial Sequence: Synthetic oligonucleotide"
auucgauuucuuuuuaguau

SEQ ID NO: 9281 - RNA, 20 nt, Artificial Sequence
  source: /note="Description of Artificial Sequence: Synthetic oligonucleotide"
uugguacacccuaaacgagg

SEQ ID NO: 9282 - RNA, 20 nt, Artificial Sequence
  source: /note="Description of Artificial Sequence: Synthetic oligonucleotide"
uauuacauaguguugguaca

SEQ ID NO: 9283 - RNA, 20 nt, Artificial Sequence
  source: /note="Description of Artificial Sequence: Synthetic oligonucleotide"
uuauuacauaguguugguac

SEQ ID NO: 9284 - RNA, 20 nt, Artificial Sequence
  source: /note="Description of Artificial Sequence: Synthetic oligonucleotide"
gaaguauugaauaagauacu

SEQ ID NO: 9285 - RNA, 20 nt, Artificial Sequence
  source: /note="Description of Artificial Sequence: Synthetic oligonucleotide"
ugaaguauugaauaagauac

SEQ ID NO: 9286 - RNA, 20 nt, Artificial Sequence
  source: /note="Description of Artificial Sequence: Synthetic oligonucleotide"
acuaaagaugguuucaaaau

SEQ ID NO: 9287 - RNA, 20 nt, Artificial Sequence
  source: /note="Description of Artificial Sequence: Synthetic oligonucleotide"
uuguuucauggucugugucu

SEQ ID NO: 9288 - RNA, 20 nt, Artificial Sequence
  source: /note="Description of Artificial Sequence: Synthetic oligonucleotide"
acguuuuauuauuagauuua

SEQ ID NO: 9289 - RNA, 20 nt, Artificial Sequence
  source: /note="Description of Artificial Sequence: Synthetic oligonucleotide"
cuuuaccugguuaaggaacu

SEQ ID NO: 9290 - RNA, 20 nt, Artificial Sequence
  source: /note="Description of Artificial Sequence: Synthetic oligonucleotide"
uaaauuauuaguuccacuuu

SEQ ID NO: 9291 - RNA, 20 nt, Artificial Sequence
  source: /note="Description of Artificial Sequence: Synthetic oligonucleotide"
cggguguguaaauuauuagu

SEQ ID NO: 9292 - RNA, 20 nt, Artificial Sequence
  source: /note="Description of Artificial Sequence: Synthetic oligonucleotide"
ucugggacagaguuuuuguu

SEQ ID NO: 9293 - RNA, 20 nt, Artificial Sequence
  source: /note="Description of Artificial Sequence: Synthetic oligonucleotide"
uaugaugacgugaggucgga

SEQ ID NO: 9294 - RNA, 20 nt, Artificial Sequence
  source: /note="Description of Artificial Sequence: Synthetic oligonucleotide"
guaugaugacgugaggucgg

SEQ ID NO: 9295 - RNA, 20 nt, Artificial Sequence
  source: /note="Description of Artificial Sequence: Synthetic oligonucleotide"
gugaacucggguccuucagu

SEQ ID NO: 9296 - RNA, 20 nt, Artificial Sequence
  source: /note="Description of Artificial Sequence: Synthetic oligonucleotide"
acccauuuagugaacucggg

SEQ ID NO: 9297 - RNA, 20 nt, Artificial Sequence
  source: /note="Description of Artificial Sequence: Synthetic oligonucleotide"
cgaugaacccuccgacucca

SEQ ID NO: 9298 - RNA, 20 nt, Artificial Sequence
  source: /note="Description of Artificial Sequence: Synthetic oligonucleotide"
ucgaugaacccuccgacucc

SEQ ID NO: 9299 - RNA, 20 nt, Artificial Sequence
  source: /note="Description of Artificial Sequence: Synthetic oligonucleotide"
ggcucgaugaacccuccgac

SEQ ID NO: 9300 - RNA, 20 nt, Artificial Sequence
  source: /note="Description of Artificial Sequence: Synthetic oligonucleotide"
acaucaggcucgaugaaccc

SEQ ID NO: 9301 - RNA, 20 nt, Artificial Sequence
  source: /note="Description of Artificial Sequence: Synthetic oligonucleotide"
cggacaucaggcucgaugaa

SEQ ID NO: 9302 - RNA, 20 nt, Artificial Sequence
  source: /note="Description of Artificial Sequence: Synthetic oligonucleotide"
acggacaucaggcucgauga

SEQ ID NO: 9303 - RNA, 20 nt, Artificial Sequence
  source: /note="Description of Artificial Sequence: Synthetic oligonucleotide"
uuuuuuaaucgguccguacc

SEQ ID NO: 9304 - RNA, 20 nt, Artificial Sequence
  source: /note="Description of Artificial Sequence: Synthetic oligonucleotide"
uauuuuuuuaaucgguccgu

SEQ ID NO: 9305 - RNA, 20 nt, Artificial Sequence
  source: /note="Description of Artificial Sequence: Synthetic oligonucleotide"
auuauuauuuuuuuaaucgg

SEQ ID NO: 9306 - RNA, 20 nt, Artificial Sequence
  source: /note="Description of Artificial Sequence: Synthetic oligonucleotide"
uucuggugugacccguugua

SEQ ID NO: 9307 - RNA, 20 nt, Artificial Sequence
  source: /note="Description of Artificial Sequence: Synthetic oligonucleotide"
guccucaaguucugguguga

SEQ ID NO: 9308 - RNA, 20 nt, Artificial Sequence
  source: /note="Description of Artificial Sequence: Synthetic oligonucleotide"
gguccucaaguucuggugug

SEQ ID NO: 9309 - RNA, 20 nt, Artificial Sequence
  source: /note="Description of Artificial Sequence: Synthetic oligonucleotide"
guccgucuaacgaacucagg

SEQ ID NO: 9310 - RNA, 20 nt, Artificial Sequence
  source: /note="Description of Artificial Sequence: Synthetic oligonucleotide"
gugagaaaccuccgacuccg

SEQ ID NO: 9311 - RNA, 20 nt, Artificial Sequence
  source: /note="Description of Artificial Sequence: Synthetic oligonucleotide"
gguagugagaaaccuccgac

SEQ ID NO: 9312 - RNA, 20 nt, Artificial Sequence
  source: /note="Description of Artificial Sequence: Synthetic oligonucleotide"
cguuaggguagugagaaacc

SEQ ID NO: 9313 - RNA, 20 nt, Artificial Sequence
  source: /note="Description of Artificial Sequence: Synthetic oligonucleotide"
ggacguuaggguagugagaa

SEQ ID NO: 9314 - RNA, 20 nt, Artificial Sequence
  source: /note="Description of Artificial Sequence: Synthetic oligonucleotide"
acgguaguccgauccacacu

SEQ ID NO: 9315 - RNA, 20 nt, Artificial Sequence
  source: /note="Description of Artificial Sequence: Synthetic oligonucleotide"
uuuucaagacgguaguccga

SEQ ID NO: 9316 - RNA, 20 nt, Artificial Sequence
  source: /note="Description of Artificial Sequence: Synthetic oligonucleotide"
aggauuuuucaagacgguag

SEQ ID NO: 9317 - RNA, 20 nt, Artificial Sequence
  source: /note="Description of Artificial Sequence: Synthetic oligonucleotide"
aguacgaagguauccuccuc

SEQ ID NO: 9318 - RNA, 20 nt, Artificial Sequence
  source: /note="Description of Artificial Sequence: Synthetic oligonucleotide"
aaguacgaagguauccuccu

SEQ ID NO: 9319 - RNA, 20 nt, Artificial Sequence
  source: /note="Description of Artificial Sequence: Synthetic oligonucleotide"
gaaguacgaagguauccucc

SEQ ID NO: 9320 - RNA, 20 nt, Artificial Sequence
  source: /note="Description of Artificial Sequence: Synthetic oligonucleotide"
agggaaguacgaagguaucc

SEQ ID NO: 9321 - RNA, 20 nt, Artificial Sequence
  source: /note="Description of Artificial Sequence: Synthetic oligonucleotide"
uuuagggaaguacgaaggua

SEQ ID NO: 9322 - RNA, 20 nt, Artificial Sequence
  source: /note="Description of Artificial Sequence: Synthetic oligonucleotide"
gauguaaguccucggucuac

SEQ ID NO: 9323 - RNA, 20 nt, Artificial Sequence
  source: /note="Description of Artificial Sequence: Synthetic oligonucleotide"
aaacacucaaaagauguaag

SEQ ID NO: 9324 - RNA, 20 nt, Artificial Sequence
  source: /note="Description of Artificial Sequence: Synthetic oligonucleotide"
guuuccguaggucaguauua

SEQ ID NO: 9325 - RNA, 20 nt, Artificial Sequence
  source: /note="Description of Artificial Sequence: Synthetic oligonucleotide"
aagucacacuuguugagguu

SEQ ID NO: 9326 - RNA, 20 nt, Artificial Sequence
  source: /note="Description of Artificial Sequence: Synthetic oligonucleotide"
auauuaacuacuuaacgacc

SEQ ID NO: 9327 - RNA, 20 nt, Artificial Sequence
  source: /note="Description of Artificial Sequence: Synthetic oligonucleotide"
uuuauauuaacuacuuaacg

SEQ ID NO: 9328 - RNA, 20 nt, Artificial Sequence
  source: /note="Description of Artificial Sequence: Synthetic oligonucleotide"
cauccuuggucacaacccua

SEQ ID NO: 9329 - RNA, 20 nt, Artificial Sequence
  source: /note="Description of Artificial Sequence: Synthetic oligonucleotide"
ggagacauccuuggucacaa

SEQ ID NO: 9330 - RNA, 20 nt, Artificial Sequence
  source: /note="Description of Artificial Sequence: Synthetic oligonucleotide"
uggagacauccuuggucaca

SEQ ID NO: 9331 - RNA, 20 nt, Artificial Sequence
  source: /note="Description of Artificial Sequence: Synthetic oligonucleotide"
ugaccucgucuuuggagaca

SEQ ID NO: 9332 - RNA, 20 nt, Artificial Sequence
  source: /note="Description of Artificial Sequence: Synthetic oligonucleotide"
auuuuucuuaaugucgaaug

SEQ ID NO: 9333 - RNA, 20 nt, Artificial Sequence
  source: /note="Description of Artificial Sequence: Synthetic oligonucleotide"
gaguguugguuccuucgucu

SEQ ID NO: 9334 - RNA, 20 nt, Artificial Sequence
  source: /note="Description of Artificial Sequence: Synthetic oligonucleotide"
uuagugacgggaguguuggu

SEQ ID NO: 9335 - RNA, 20 nt, Artificial Sequence
  source: /note="Description of Artificial Sequence: Synthetic oligonucleotide"
cagucucuuuacuccagugu

SEQ ID NO: 9336 - RNA, 20 nt, Artificial Sequence
  source: /note="Description of Artificial Sequence: Synthetic oligonucleotide"
acagucucuuuacuccagug

SEQ ID NO: 9337 - RNA, 20 nt, Artificial Sequence
  source: /note="Description of Artificial Sequence: Synthetic oligonucleotide"
aaucuagacagucucuuuac

SEQ ID NO: 9338 - RNA, 20 nt, Artificial Sequence
  source: /note="Description of Artificial Sequence: Synthetic oligonucleotide"
uuagacuuauauggauguug

SEQ ID NO: 9339 - RNA, 20 nt, Artificial Sequence
  source: /note="Description of Artificial Sequence: Synthetic oligonucleotide"
guaugaguauaaaauaaccu

SEQ ID NO: 9340 - RNA, 20 nt, Artificial Sequence
  source: /note="Description of Artificial Sequence: Synthetic oligonucleotide"
agcuguaugaguauaaaaua

SEQ ID NO: 9341 - RNA, 20 nt, Artificial Sequence
  source: /note="Description of Artificial Sequence: Synthetic oligonucleotide"
uuuauaugaggauaugucag

SEQ ID NO: 9342 - RNA, 20 nt, Artificial Sequence
  source: /note="Description of Artificial Sequence: Synthetic oligonucleotide"
uuguucguuuaaacccauua

SEQ ID NO: 9343 - RNA, 20 nt, Artificial Sequence
  source: /note="Description of Artificial Sequence: Synthetic oligonucleotide"
guacuuauuguucguuuaaa

SEQ ID NO: 9344 - RNA, 20 nt, Artificial Sequence
  source: /note="Description of Artificial Sequence: Synthetic oligonucleotide"
uguacuuauuguucguuuaa

SEQ ID NO: 9345 - RNA, 20 nt, Artificial Sequence
  source: /note="Description of Artificial Sequence: Synthetic oligonucleotide"
ugcacuuuguaagagguccu

SEQ ID NO: 9346 - RNA, 20 nt, Artificial Sequence
  source: /note="Description of Artificial Sequence: Synthetic oligonucleotide"
cgugugcacuuuguaagagg

SEQ ID NO: 9347 - RNA, 20 nt, Artificial Sequence
  source: /note="Description of Artificial Sequence: Synthetic oligonucleotide"
uuuuugugauauuugguuga

SEQ ID NO: 9348 - RNA, 20 nt, Artificial Sequence
  source: /note="Description of Artificial Sequence: Synthetic oligonucleotide"
augauuaggugaaaguuauu

SEQ ID NO: 9349 - RNA, 20 nt, Artificial Sequence
  source: /note="Description of Artificial Sequence: Synthetic oligonucleotide"
cguuuuuuaccgucuuaauu

SEQ ID NO: 9350 - RNA, 20 nt, Artificial Sequence
  source: /note="Description of Artificial Sequence: Synthetic oligonucleotide"
uuuuauguacuucguuuuuu

SEQ ID NO: 9351 - RNA, 20 nt, Artificial Sequence
  source: /note="Description of Artificial Sequence: Synthetic oligonucleotide"
uauauuuaacuuuuuaauuu

SEQ ID NO: 9352 - RNA, 20 nt, Artificial Sequence
  source: /note="Description of Artificial Sequence: Synthetic oligonucleotide"
uucuguucuaugucuguuuu

SEQ ID NO: 9353 - RNA, 20 nt, Artificial Sequence
  source: /note="Description of Artificial Sequence: Synthetic oligonucleotide"
uuuuuaaaucauuuucuguu

SEQ ID NO: 9354 - RNA, 20 nt, Artificial Sequence
  source: /note="Description of Artificial Sequence: Synthetic oligonucleotide"
uuuuuuaaaucauuuucugu

SEQ ID NO: 9355 - RNA, 20 nt, Artificial Sequence
  source: /note="Description of Artificial Sequence: Synthetic oligonucleotide"
auucaaucaacauuaggggu

SEQ ID NO: 9356 - RNA, 20 nt, Artificial Sequence
  source: /note="Description of Artificial Sequence: Synthetic oligonucleotide"
uauucaaucaacauuagggg

SEQ ID NO: 9357 - RNA, 20 nt, Artificial Sequence
  source: /note="Description of Artificial Sequence: Synthetic oligonucleotide"
aggaauauaacauuacuuua

SEQ ID NO: 9358 - RNA, 20 nt, Artificial Sequence
  source: /note="Description of Artificial Sequence: Synthetic oligonucleotide"
uucucccuuacaucgauaua

SEQ ID NO: 9359 - RNA, 20 nt, Artificial Sequence
  source: /note="Description of Artificial Sequence: Synthetic oligonucleotide"
uuucucccuuacaucgauau

SEQ ID NO: 9360 - RNA, 20 nt, Artificial Sequence
  source: /note="Description of Artificial Sequence: Synthetic oligonucleotide"
uuaucgugucucauuuuucu

SEQ ID NO: 9361 - RNA, 20 nt, Artificial Sequence
  source: /note="Description of Artificial Sequence: Synthetic oligonucleotide"
auuaucgugucucauuuuuc

SEQ ID NO: 9362 - RNA, 20 nt, Artificial Sequence
  source: /note="Description of Artificial Sequence: Synthetic oligonucleotide"
uuuuguauuagacacaauua

SEQ ID NO: 9363 - RNA, 20 nt, Artificial Sequence
  source: /note="Description of Artificial Sequence: Synthetic oligonucleotide"
uuuuuguauuagacacaauu

SEQ ID NO: 9364 - RNA, 20 nt, Artificial Sequence
  source: /note="Description of Artificial Sequence: Synthetic oligonucleotide"
uggucauuucuauuaaugua

SEQ ID NO: 9365 - RNA, 20 nt, Artificial Sequence
  source: /note="Description of Artificial Sequence: Synthetic oligonucleotide"
uaugaaguccgacuuuccuu

SEQ ID NO: 9366 - RNA, 20 nt, Artificial Sequence
  source: /note="Description of Artificial Sequence: Synthetic oligonucleotide"
uuacauaugaaguccgacuu

SEQ ID NO: 9367 - RNA, 20 nt, Artificial Sequence
  source: /note="Description of Artificial Sequence: Synthetic oligonucleotide"
uuuaugauuuacauaugaag

SEQ ID NO: 9368 - RNA, 20 nt, Artificial Sequence
  source: /note="Description of Artificial Sequence: Synthetic oligonucleotide"
uuauucucaaauaacaaaag

SEQ ID NO: 9369 - RNA, 20 nt, Artificial Sequence
  source: /note="Description of Artificial Sequence: Synthetic oligonucleotide"
uuacauaauauauuauuuaa

SEQ ID NO: 9370 - RNA, 20 nt, Artificial Sequence
  source: /note="Description of Artificial Sequence: Synthetic oligonucleotide"
gucuuuguuacuucuggucu

SEQ ID NO: 9371 - RNA, 20 nt, Artificial Sequence
  source: /note="Description of Artificial Sequence: Synthetic oligonucleotide"
acauacuaauaguacauacg

SEQ ID NO: 9372 - RNA, 20 nt, Artificial Sequence
  source: /note="Description of Artificial Sequence: Synthetic oligonucleotide"
cuucuuauaaacuuuuuauu

SEQ ID NO: 9373 - RNA, 20 nt, Artificial Sequence
  source: /note="Description of Artificial Sequence: Synthetic oligonucleotide"
cuccuacuucuuauuucuua

SEQ ID NO: 9374 - RNA, 20 nt, Artificial Sequence
  source: /note="Description of Artificial Sequence: Synthetic oligonucleotide"
uuacguccagggguuucauc

SEQ ID NO: 9375 - RNA, 20 nt, Artificial Sequence
  source: /note="Description of Artificial Sequence: Synthetic oligonucleotide"
augguuguaucuguauuacg

SEQ ID NO: 9376 - RNA, 20 nt, Artificial Sequence
  source: /note="Description of Artificial Sequence: Synthetic oligonucleotide"
uugucuuggagucucuagac

SEQ ID NO: 9377 - RNA, 20 nt, Artificial Sequence
  source: /note="Description of Artificial Sequence: Synthetic oligonucleotide"
caacuuuuccuccccuuuuu

SEQ ID NO: 9378 - RNA, 20 nt, Artificial Sequence
  source: /note="Description of Artificial Sequence: Synthetic oligonucleotide"
ucaacuuuuccuccccuuuu

SEQ ID NO: 9379 - RNA, 20 nt, Artificial Sequence
  source: /note="Description of Artificial Sequence: Synthetic oligonucleotide"
uaucgucucaacuuuuccuc

SEQ ID NO: 9380 - RNA, 20 nt, Artificial Sequence
  source: /note="Description of Artificial Sequence: Synthetic oligonucleotide"
uuaucgucucaacuuuuccu

SEQ ID NO: 9381 - RNA, 20 nt, Artificial Sequence
  source: /note="Description of Artificial Sequence: Synthetic oligonucleotide"
guuaucgucucaacuuuucc

SEQ ID NO: 9382 - RNA, 20 nt, Artificial Sequence
  source: /note="Description of Artificial Sequence: Synthetic oligonucleotide"
caaguuaucgucucaacuuu

SEQ ID NO: 9383 - RNA, 20 nt, Artificial Sequence
  source: /note="Description of Artificial Sequence: Synthetic oligonucleotide"
uugacgucauuuuuaaucuc

SEQ ID NO: 9384 - RNA, 20 nt, Artificial Sequence
  source: /note="Description of Artificial Sequence: Synthetic oligonucleotide"
auugacgucauuuuuaaucu

SEQ ID NO: 9385 - RNA, 20 nt, Artificial Sequence
  source: /note="Description of Artificial Sequence: Synthetic oligonucleotide"
uauugacgucauuuuuaauc

SEQ ID NO: 9386 - RNA, 20 nt, Artificial Sequence
  source: /note="Description of Artificial Sequence: Synthetic oligonucleotide"
uucaggucuacaauccggug

SEQ ID NO: 9387 - RNA, 20 nt, Artificial Sequence
  source: /note="Description of Artificial Sequence: Synthetic oligonucleotide"
ggacuuuuucaggucuacaa

SEQ ID NO: 9388 - RNA, 20 nt, Artificial Sequence
  source: /note="Description of Artificial Sequence: Synthetic oligonucleotide"
gggauauuucaucaguuauc

SEQ ID NO: 9389 - RNA, 20 nt, Artificial Sequence
  source: /note="Description of Artificial Sequence: Synthetic oligonucleotide"
ucucuuugucuuuguuucau

SEQ ID NO: 9390 - RNA, 20 nt, Artificial Sequence
  source: /note="Description of Artificial Sequence: Synthetic oligonucleotide"
agaguugcacgacccuaaug

SEQ ID NO: 9391 - RNA, 20 nt, Artificial Sequence
  source: /note="Description of Artificial Sequence: Synthetic oligonucleotide"
gaaaccggagaguugcacga

SEQ ID NO: 9392 - RNA, 20 nt, Artificial Sequence
  source: /note="Description of Artificial Sequence: Synthetic oligonucleotide"
cgaaaccggagaguugcacg

SEQ ID NO: 9393 - RNA, 20 nt, Artificial Sequence
  source: /note="Description of Artificial Sequence: Synthetic oligonucleotide"
gaauucacuacgaggacgaa

SEQ ID NO: 9394 - RNA, 20 nt, Artificial Sequence
  source: /note="Description of Artificial Sequence: Synthetic oligonucleotide"
guccgaucagaacuugagga

SEQ ID NO: 9395 - RNA, 20 nt, Artificial Sequence
  source: /note="Description of Artificial Sequence: Synthetic oligonucleotide"
gguccgaucagaacuugagg

SEQ ID NO: 9396 - RNA, 20 nt, Artificial Sequence
  source: /note="Description of Artificial Sequence: Synthetic oligonucleotide"
ucccagagugauacgacggg

SEQ ID NO: 9397 - RNA, 20 nt, Artificial Sequence
  source: /note="Description of Artificial Sequence: Synthetic oligonucleotide"
aaaaauaaaaacaucucugu

SEQ ID NO: 9398 - RNA, 20 nt, Artificial Sequence
  source: /note="Description of Artificial Sequence: Synthetic oligonucleotide"
uaaaaauaaaaacaucucug

SEQ ID NO: 9399 - RNA, 20 nt, Artificial Sequence
  source: /note="Description of Artificial Sequence: Synthetic oligonucleotide"
ucauuguauaagacccgucc

SEQ ID NO: 9400 - RNA, 20 nt, Artificial Sequence
  source: /note="Description of Artificial Sequence: Synthetic oligonucleotide"
gucauuguauaagacccguc

SEQ ID NO: 9401 - RNA, 20 nt, Artificial Sequence
  source: /note="Description of Artificial Sequence: Synthetic oligonucleotide"
ugucauuguauaagacccgu

SEQ ID NO: 9402 - RNA, 20 nt, Artificial Sequence
  source: /note="Description of Artificial Sequence: Synthetic oligonucleotide"
uugucauuguauaagacccg

SEQ ID NO: 9403 - RNA, 20 nt, Artificial Sequence
  source: /note="Description of Artificial Sequence: Synthetic oligonucleotide"
gucuuugucauuguauaaga

SEQ ID NO: 9404 - RNA, 20 nt, Artificial Sequence
  source: /note="Description of Artificial Sequence: Synthetic oligonucleotide"
ggucuuugucauuguauaag

SEQ ID NO: 9405 - RNA, 20 nt, Artificial Sequence
  source: /note="Description of Artificial Sequence: Synthetic oligonucleotide"
ucuuuguuauguuugaaaua

SEQ ID NO: 9406 - RNA, 20 nt, Artificial Sequence
  source: /note="Description of Artificial Sequence: Synthetic oligonucleotide"
auugguucguuucugaagcu

SEQ ID NO: 9407 - RNA, 20 nt, Artificial Sequence
  source: /note="Description of Artificial Sequence: Synthetic oligonucleotide"
aauaacuagaguccguggau

SEQ ID NO: 9408 - RNA, 20 nt, Artificial Sequence
  source: /note="Description of Artificial Sequence: Synthetic oligonucleotide"
uucugacugaauaacuagag

SEQ ID NO: 9409 - RNA, 20 nt, Artificial Sequence
  source: /note="Description of Artificial Sequence: Synthetic oligonucleotide"
uaggucucgacguuuaucgg

SEQ ID NO: 9410 - RNA, 20 nt, Artificial Sequence
  source: /note="Description of Artificial Sequence: Synthetic oligonucleotide"
agacguguucgucccuuauu

SEQ ID NO: 9411 - RNA, 20 nt, Artificial Sequence
  source: /note="Description of Artificial Sequence: Synthetic oligonucleotide"
gaacucugagacguguucgu

SEQ ID NO: 9412 - RNA, 20 nt, Artificial Sequence
  source: /note="Description of Artificial Sequence: Synthetic oligonucleotide"
ggaacucugagacguguucg

SEQ ID NO: 9413 - RNA, 20 nt, Artificial Sequence
  source: /note="Description of Artificial Sequence: Synthetic oligonucleotide"
cuuucgguguacguugacau

SEQ ID NO: 9414 - RNA, 20 nt, Artificial Sequence
  source: /note="Description of Artificial Sequence: Synthetic oligonucleotide"
ucuuucgguguacguugaca

SEQ ID NO: 9415 - RNA, 20 nt, Artificial Sequence
  source: /note="Description of Artificial Sequence: Synthetic oligonucleotide"
ccgaaacuuuuauauaagga

SEQ ID NO: 9416 - RNA, 20 nt, Artificial Sequence
  source: /note="Description of Artificial Sequence: Synthetic oligonucleotide"
uccgaaacuuuuauauaagg

SEQ ID NO: 9417 - RNA, 20 nt, Artificial Sequence
  source: /note="Description of Artificial Sequence: Synthetic oligonucleotide"
cuuuacucuacuaggugucc

SEQ ID NO: 9418 - RNA, 20 nt, Artificial Sequence
  source: /note="Description of Artificial Sequence: Synthetic oligonucleotide"
acccuuuacucuacuaggug

SEQ ID NO: 9419 - RNA, 20 nt, Artificial Sequence
  source: /note="Description of Artificial Sequence: Synthetic oligonucleotide"
ucgaauuuucauuuaaugga

SEQ ID NO: 9420 - RNA, 20 nt, Artificial Sequence
  source: /note="Description of Artificial Sequence: Synthetic oligonucleotide"
uucgaauuuucauuuaaugg

SEQ ID NO: 9421 - RNA, 20 nt, Artificial Sequence
  source: /note="Description of Artificial Sequence: Synthetic oligonucleotide"
ugaguccacaucgauuauug

SEQ ID NO: 9422 - RNA, 20 nt, Artificial Sequence
  source: /note="Description of Artificial Sequence: Synthetic oligonucleotide"
aacuuauaacagugacugag

SEQ ID NO: 9423 - RNA, 20 nt, Artificial Sequence
  source: /note="Description of Artificial Sequence: Synthetic oligonucleotide"
ccguaaacaguuuauuagua

SEQ ID NO: 9424 - RNA, 20 nt, Artificial Sequence
  source: /note="Description of Artificial Sequence: Synthetic oligonucleotide"
cacuugguggaaaagguguc

SEQ ID NO: 9425 - RNA, 20 nt, Artificial Sequence
  source: /note="Description of Artificial Sequence: Synthetic oligonucleotide"
auagaaaugaaauagauuga

SEQ ID NO: 9426 - RNA, 20 nt, Artificial Sequence
  source: /note="Description of Artificial Sequence: Synthetic oligonucleotide"
ggaccuucuagggugaucau

SEQ ID NO: 9427 - RNA, 20 nt, Artificial Sequence
  source: /note="Description of Artificial Sequence: Synthetic oligonucleotide"
acuggacaaaccaucaaagg

SEQ ID NO: 9428 - RNA, 20 nt, Artificial Sequence
  source: /note="Description of Artificial Sequence: Synthetic oligonucleotide"
gaauguaauaaacuggacaa

SEQ ID NO: 9429 - RNA, 20 nt, Artificial Sequence
  source: /note="Description of Artificial Sequence: Synthetic oligonucleotide"
accuauaugagaucugacca

SEQ ID NO: 9430 - RNA, 20 nt, Artificial Sequence
  source: /note="Description of Artificial Sequence: Synthetic oligonucleotide"
accaaccuauaugagaucug

SEQ ID NO: 9431 - RNA, 20 nt, Artificial Sequence
  source: /note="Description of Artificial Sequence: Synthetic oligonucleotide"
gaucuccuccggucuaacca

SEQ ID NO: 9432 - RNA, 20 nt, Artificial Sequence
  source: /note="Description of Artificial Sequence: Synthetic oligonucleotide"
cggugaucuccuccggucua

SEQ ID NO: 9433 - RNA, 20 nt, Artificial Sequence
  source: /note="Description of Artificial Sequence: Synthetic oligonucleotide"
ucgguccgacggugaucucc

SEQ ID NO: 9434 - RNA, 20 nt, Artificial Sequence
  source: /note="Description of Artificial Sequence: Synthetic oligonucleotide"
ucgucgguccgacggugauc

SEQ ID NO: 9435 - RNA, 20 nt, Artificial Sequence
  source: /note="Description of Artificial Sequence: Synthetic oligonucleotide"
auaauacuuuucgucgucgg

SEQ ID NO: 9436 - RNA, 20 nt, Artificial Sequence
  source: /note="Description of Artificial Sequence: Synthetic oligonucleotide"
auugaaaggggugucgagau

SEQ ID NO: 9437 - RNA, 20 nt, Artificial Sequence
  source: /note="Description of Artificial Sequence: Synthetic oligonucleotide"
ucacucuucucacucgagac

SEQ ID NO: 9438 - RNA, 20 nt, Artificial Sequence
  source: /note="Description of Artificial Sequence: Synthetic oligonucleotide"
acaaguucccuuuuuuucug

SEQ ID NO: 9439 - RNA, 20 nt, Artificial Sequence
  source: /note="Description of Artificial Sequence: Synthetic oligonucleotide"
auaucccucuuaaacaaguu

SEQ ID NO: 9440 - RNA, 20 nt, Artificial Sequence
  source: /note="Description of Artificial Sequence: Synthetic oligonucleotide"
uauaucccucuuaaacaagu

SEQ ID NO: 9441 - RNA, 20 nt, Artificial Sequence
  source: /note="Description of Artificial Sequence: Synthetic oligonucleotide"
uuuuucgaacgucguuauau

SEQ ID NO: 9442 - RNA, 20 nt, Artificial Sequence
  source: /note="Description of Artificial Sequence: Synthetic oligonucleotide"
guuuuucgaacgucguuaua

SEQ ID NO: 9443 - RNA, 20 nt, Artificial Sequence
  source: /note="Description of Artificial Sequence: Synthetic oligonucleotide"
ucuuagucgaaaaagucuag

SEQ ID NO: 9444 - RNA, 20 nt, Artificial Sequence
  source: /note="Description of Artificial Sequence: Synthetic oligonucleotide"
agucguuuuuaccgucuuau

SEQ ID NO: 9445 - RNA, 20 nt, Artificial Sequence
  source: /note="Description of Artificial Sequence: Synthetic oligonucleotide"
aaaugucuacagucguuuuu

SEQ ID NO: 9446 - RNA, 20 nt, Artificial Sequence
  source: /note="Description of Artificial Sequence: Synthetic oligonucleotide"
aaggucgauuauuuacguuu

SEQ ID NO: 9447 - RNA, 20 nt, Artificial Sequence
  source: /note="Description of Artificial Sequence: Synthetic oligonucleotide"
uaccauugauugccaacuac

SEQ ID NO: 9448 - RNA, 20 nt, Artificial Sequence
  source: /note="Description of Artificial Sequence: Synthetic oligonucleotide"
gauauaauuuaccauugauu

SEQ ID NO: 9449 - RNA, 20 nt, Artificial Sequence
  source: /note="Description of Artificial Sequence: Synthetic oligonucleotide"
aagaauguuugauauaauuu

SEQ ID NO: 9450 - RNA, 20 nt, Artificial Sequence
  source: /note="Description of Artificial Sequence: Synthetic oligonucleotide"
cauuacuguggagguaucgu

SEQ ID NO: 9451 - RNA, 20 nt, Artificial Sequence
  source: /note="Description of Artificial Sequence: Synthetic oligonucleotide"
ucauuacuguggagguaucg

SEQ ID NO: 9452 - RNA, 20 nt, Artificial Sequence
  source: /note="Description of Artificial Sequence: Synthetic oligonucleotide"
uaugagacaguugauacuua

SEQ ID NO: 9453 - RNA, 20 nt, Artificial Sequence
  source: /note="Description of Artificial Sequence: Synthetic oligonucleotide"
ugaauguucuuuuuuauaag

SEQ ID NO: 9454 - RNA, 20 nt, Artificial Sequence
  source: /note="Description of Artificial Sequence: Synthetic oligonucleotide"
cucacgauccaggaucaaag

SEQ ID NO: 9455 - RNA, 20 nt, Artificial Sequence
  source: /note="Description of Artificial Sequence: Synthetic oligonucleotide"
aacuacccguaaacucacga

SEQ ID NO: 9456 - RNA, 20 nt, Artificial Sequence
  source: /note="Description of Artificial Sequence: Synthetic oligonucleotide"
acuuaauaagaugguaacua

SEQ ID NO: 9457 - RNA, 20 nt, Artificial Sequence
  source: /note="Description of Artificial Sequence: Synthetic oligonucleotide"
uacuuaauaagaugguaacu

SEQ ID NO: 9458 - RNA, 20 nt, Artificial Sequence
  source: /note="Description of Artificial Sequence: Synthetic oligonucleotide"
cacgaaaaagguaauacaaa

SEQ ID NO: 9459 - RNA, 20 nt, Artificial Sequence
  source: /note="Description of Artificial Sequence: Synthetic oligonucleotide"
acacgaaaaagguaauacaa

SEQ ID NO: 9460 - RNA, 20 nt, Artificial Sequence
  source: /note="Description of Artificial Sequence: Synthetic oligonucleotide"
uugauauauacauagguauu

SEQ ID NO: 9461 - RNA, 20 nt, Artificial Sequence
  source: /note="Description of Artificial Sequence: Synthetic oligonucleotide"
aaaauacuugauauauacau

SEQ ID NO: 9462 - RNA, 20 nt, Artificial Sequence
  source: /note="Description of Artificial Sequence: Synthetic oligonucleotide"
aggguuuaucgaccuugaua

SEQ ID NO: 9463 - RNA, 20 nt, Artificial Sequence
  source: /note="Description of Artificial Sequence: Synthetic oligonucleotide"
cggagucggaggguuuaucg

SEQ ID NO: 9464 - RNA, 20 nt, Artificial Sequence
  source: /note="Description of Artificial Sequence: Synthetic oligonucleotide"
guccaacuuggacuugaaga

SEQ ID NO: 9465 - RNA, 20 nt, Artificial Sequence
  source: /note="Description of Artificial Sequence: Synthetic oligonucleotide"
aguccaacuuggacuugaag

SEQ ID NO: 9466 - RNA, 20 nt, Artificial Sequence
  source: /note="Description of Artificial Sequence: Synthetic oligonucleotide"
ccccagaacgauacaacgag

SEQ ID NO: 9467 - RNA, 20 nt, Artificial Sequence
  source: /note="Description of Artificial Sequence: Synthetic oligonucleotide"
ugcaaagaaaaaaugucuac

SEQ ID NO: 9468 - RNA, 20 nt, Artificial Sequence
  source: /note="Description of Artificial Sequence: Synthetic oligonucleotide"
augcaaagaaaaaaugucua

SEQ ID NO: 9469 - RNA, 20 nt, Artificial Sequence
  source: /note="Description of Artificial Sequence: Synthetic oligonucleotide"
aaugcaaagaaaaaaugucu

SEQ ID NO: 9470 - RNA, 20 nt, Artificial Sequence
  source: /note="Description of Artificial Sequence: Synthetic oligonucleotide"
uguuuuauaaaugauagggg

SEQ ID NO: 9471 - RNA, 20 nt, Artificial Sequence
  source: /note="Description of Artificial Sequence: Synthetic oligonucleotide"
uauuaaaaugucaaauguuu

SEQ ID NO: 9472 - RNA, 20 nt, Artificial Sequence
  source: /note="Description of Artificial Sequence: Synthetic oligonucleotide"
agauugagacauaauucgac

SEQ ID NO: 9473 - RNA, 20 nt, Artificial Sequence
  source: /note="Description of Artificial Sequence: Synthetic oligonucleotide"
ggcugugcagcugauauuau

SEQ ID NO: 9474 - RNA, 20 nt, Artificial Sequence
  source: /note="Description of Artificial Sequence: Synthetic oligonucleotide"
ugcuauggauagcauuauau

SEQ ID NO: 9475 - RNA, 20 nt, Artificial Sequence
  source: /note="Description of Artificial Sequence: Synthetic oligonucleotide"
gugaacaauaugacauaucu

SEQ ID NO: 9476 - RNA, 20 nt, Artificial Sequence
  source: /note="Description of Artificial Sequence: Synthetic oligonucleotide"
auacacacuauuuuuuaagu

SEQ ID NO: 9477 - RNA, 20 nt, Artificial Sequence
  source: /note="Description of Artificial Sequence: Synthetic oligonucleotide"
agcaacaaaaacuuccucuu

SEQ ID NO: 9478 - RNA, 20 nt, Artificial Sequence
  source: /note="Description of Artificial Sequence: Synthetic oligonucleotide"
uguuaauuccaaaguuuuaa

SEQ ID NO: 9479 - RNA, 20 nt, Artificial Sequence
  source: /note="Description of Artificial Sequence: Synthetic oligonucleotide"
guuaauuccaaaguuuuaaa

SEQ ID NO: 9480 - RNA, 20 nt, Artificial Sequence
  source: /note="Description of Artificial Sequence: Synthetic oligonucleotide"
uuaauuccaaaguuuuaaag

SEQ ID NO: 9481 - RNA, 20 nt, Artificial Sequence
  source: /note="Description of Artificial Sequence: Synthetic oligonucleotide"
uguuaaaacuaaaugagaau

SEQ ID NO: 9482 - RNA, 20 nt, Artificial Sequence
  source: /note="Description of Artificial Sequence: Synthetic oligonucleotide"
cauauuuugacucugaauua

SEQ ID NO: 9483 - RNA, 20 nt, Artificial Sequence
  source: /note="Description of Artificial Sequence: Synthetic oligonucleotide"
auuuuaauauaacucuguaa

SEQ ID NO: 9484 - RNA, 20 nt, Artificial Sequence
  source: /note="Description of Artificial Sequence: Synthetic oligonucleotide"
aacucuguaauggaaauaaa

SEQ ID NO: 9485 - RNA, 20 nt, Artificial Sequence
  source: /note="Description of Artificial Sequence: Synthetic oligonucleotide"
uaauuucucacugaagucau

SEQ ID NO: 9486 - RNA, 20 nt, Artificial Sequence
  source: /note="Description of Artificial Sequence: Synthetic oligonucleotide"
uugauaaauuuaacaacuuu

SEQ ID NO: 9487 - RNA, 20 nt, Artificial Sequence
  source: /note="Description of Artificial Sequence: Synthetic oligonucleotide"
ugauaaauuuaacaacuuuu

SEQ ID NO: 9488 - RNA, 20 nt, Artificial Sequence
  source: /note="Description of Artificial Sequence: Synthetic oligonucleotide"
uaaauuuaacaacuuuuggg

SEQ ID NO: 9489 - RNA, 20 nt, Artificial Sequence
  source: /note="Description of Artificial Sequence: Synthetic oligonucleotide"
uagauacuucuugacuuaug

SEQ ID NO: 9490 - RNA, 20 nt, Artificial Sequence
  source: /note="Description of Artificial Sequence: Synthetic oligonucleotide"
aaaaaaaacgaagccauuau

SEQ ID NO: 9491 - RNA, 20 nt, Artificial Sequence
  source: /note="Description of Artificial Sequence: Synthetic oligonucleotide"
aaacgaagccauuauagguc

SEQ ID NO: 9492 - RNA, 20 nt, Artificial Sequence
  source: /note="Description of Artificial Sequence: Synthetic oligonucleotide"
aacgaagccauuauagguca

SEQ ID NO: 9493 - RNA, 20 nt, Artificial Sequence
  source: /note="Description of Artificial Sequence: Synthetic oligonucleotide"
ucacaguauaaguuuuuuaa

SEQ ID NO: 9494 - RNA, 20 nt, Artificial Sequence
  source: /note="Description of Artificial Sequence: Synthetic oligonucleotide"
aaauguuuaucacuuucacg

SEQ ID NO: 9495 - RNA, 20 nt, Artificial Sequence
  source: /note="Description of Artificial Sequence: Synthetic oligonucleotide"
uucauguaaaccaaauccag

SEQ ID NO: 9496 - RNA, 20 nt, Artificial Sequence
  source: /note="Description of Artificial Sequence: Synthetic oligonucleotide"
aaguaacuuauugccucugu

SEQ ID NO: 9497 - RNA, 20 nt, Artificial Sequence
  source: /note="Description of Artificial Sequence: Synthetic oligonucleotide"
aguaacuuauugccucuguu

SEQ ID NO: 9498 - RNA, 20 nt, Artificial Sequence
  source: /note="Description of Artificial Sequence: Synthetic oligonucleotide"
acuuauugccucuguugggu

SEQ ID NO: 9499 - RNA, 20 nt, Artificial Sequence
  source: /note="Description of Artificial Sequence: Synthetic oligonucleotide"
cuaaaauuuacaucucugcc

SEQ ID NO: 9500 - RNA, 20 nt, Artificial Sequence
  source: /note="Description of Artificial Sequence: Synthetic oligonucleotide"
aaauuuacaucucugccagg

SEQ ID NO: 9501 - RNA, 20 nt, Artificial Sequence
  source: /note="Description of Artificial Sequence: Synthetic oligonucleotide"
ugaagacuucuaaguauaaa

SEQ ID NO: 9502 - RNA, 20 nt, Artificial Sequence
  source: /note="Description of Artificial Sequence: Synthetic oligonucleotide"
uuuuuuaacaguauauuacu

SEQ ID NO: 9503 - RNA, 20 nt, Artificial Sequence
  source: /note="Description of Artificial Sequence: Synthetic oligonucleotide"
aaaaucuguucuucaugagc

SEQ ID NO: 9504 - RNA, 20 nt, Artificial Sequence
  source: /note="Description of Artificial Sequence: Synthetic oligonucleotide"
aaaucuguucuucaugagca

SEQ ID NO: 9505 - RNA, 20 nt, Artificial Sequence
  source: /note="Description of Artificial Sequence: Synthetic oligonucleotide"
cuguucuucaugagcagggc

SEQ ID NO: 9506 - RNA, 20 nt, Artificial Sequence
  source: /note="Description of Artificial Sequence: Synthetic oligonucleotide"
uucuucaugagcagggcagg

SEQ ID NO: 9507 - RNA, 20 nt, Artificial Sequence
  source: /note="Description of Artificial Sequence: Synthetic oligonucleotide"
ucuucaugagcagggcaggu

SEQ ID NO: 9508 - RNA, 20 nt, Artificial Sequence
  source: /note="Description of Artificial Sequence: Synthetic oligonucleotide"
cuucaugagcagggcaggug

SEQ ID NO: 9509 - RNA, 20 nt, Artificial Sequence
  source: /note="Description of Artificial Sequence: Synthetic oligonucleotide"
uucaugagcagggcaggugg

SEQ ID NO: 9510 - RNA, 20 nt, Artificial Sequence
  source: /note="Description of Artificial Sequence: Synthetic oligonucleotide"
cuuucaaguaaauucugcaa

SEQ ID NO: 9511 - RNA, 20 nt, Artificial Sequence
  source: /note="Description of Artificial Sequence: Synthetic oligonucleotide"
aguaaauuuuaguugcucua

SEQ ID NO: 9512 - RNA, 20 nt, Artificial Sequence
  source: /note="Description of Artificial Sequence: Synthetic oligonucleotide"
uuuuaauaguucaucuuccu

SEQ ID NO: 9513 - RNA, 20 nt, Artificial Sequence
  source: /note="Description of Artificial Sequence: Synthetic oligonucleotide"
gugaccucuuuaagaccaua

SEQ ID NO: 9514 - RNA, 20 nt, Artificial Sequence
  source: /note="Description of Artificial Sequence: Synthetic oligonucleotide"
aauuccccuaacccuacucc

SEQ ID NO: 9515 - RNA, 20 nt, Artificial Sequence
  source: /note="Description of Artificial Sequence: Synthetic oligonucleotide"
ccuaacccuacuccuggcac

SEQ ID NO: 9516 - RNA, 20 nt, Artificial Sequence
  source: /note="Description of Artificial Sequence: Synthetic oligonucleotide"
gaugcuuuauuuaguaauaa

SEQ ID NO: 9517 - RNA, 20 nt, Artificial Sequence
  source: /note="Description of Artificial Sequence: Synthetic oligonucleotide"
aaggcaccauauauuguguu

SEQ ID NO: 9518 - RNA, 20 nt, Artificial Sequence
  source: /note="Description of Artificial Sequence: Synthetic oligonucleotide"
aggcaccauauauuguguuu

SEQ ID NO: 9519 - RNA, 20 nt, Artificial Sequence
  source: /note="Description of Artificial Sequence: Synthetic oligonucleotide"
uguuugggauucaaaaugua

SEQ ID NO: 9520 - RNA, 20 nt, Artificial Sequence
  source: /note="Description of Artificial Sequence: Synthetic oligonucleotide"
guuugggauucaaaauguaa

SEQ ID NO: 9521 - RNA, 20 nt, Artificial Sequence
  source: /note="Description of Artificial Sequence: Synthetic oligonucleotide"
uuugggauucaaaauguaag

SEQ ID NO: 9522 - RNA, 20 nt, Artificial Sequence
  source: /note="Description of Artificial Sequence: Synthetic oligonucleotide"
ucucuuuuacauagagaaaa

SEQ ID NO: 9523 - RNA, 20 nt, Artificial Sequence
  source: /note="Description of Artificial Sequence: Synthetic oligonucleotide"
gaaguaaacaaaccucuuuu

SEQ ID NO: 9524 - RNA, 20 nt, Artificial Sequence
  source: /note="Description of Artificial Sequence: Synthetic oligonucleotide"
ggaaguaaacaaaccucuuu

SEQ ID NO: 9525 - RNA, 20 nt, Artificial Sequence
  source: /note="Description of Artificial Sequence: Synthetic oligonucleotide"
aaauaaagcgauuauacauc

SEQ ID NO: 9526 - RNA, 20 nt, Artificial Sequence
  source: /note="Description of Artificial Sequence: Synthetic oligonucleotide"
auaguguguaucuacaguuu

SEQ ID NO: 9527 - RNA, 20 nt, Artificial Sequence
  source: /note="Description of Artificial Sequence: Synthetic oligonucleotide"
aauaguguguaucuacaguu

SEQ ID NO: 9528 - RNA, 20 nt, Artificial Sequence
  source: /note="Description of Artificial Sequence: Synthetic oligonucleotide"
ucaaauuuuaucuauuauuu

SEQ ID NO: 9529 - RNA, 20 nt, Artificial Sequence
  source: /note="Description of Artificial Sequence: Synthetic oligonucleotide"
auuaacauaaaagaccaaag

SEQ ID NO: 9530 - RNA, 20 nt, Artificial Sequence
  source: /note="Description of Artificial Sequence: Synthetic oligonucleotide"
gugacaccccuuuaaaacuu

SEQ ID NO: 9531 - RNA, 20 nt, Artificial Sequence
  source: /note="Description of Artificial Sequence: Synthetic oligonucleotide"
cacauaaaugugacuaaaaa

SEQ ID NO: 9532 - RNA, 20 nt, Artificial Sequence
  source: /note="Description of Artificial Sequence: Synthetic oligonucleotide"
ucauuuuacaacggauuuau

SEQ ID NO: 9533 - RNA, 20 nt, Artificial Sequence
  source: /note="Description of Artificial Sequence: Synthetic oligonucleotide"
aauggauuuucauuuuacaa

SEQ ID NO: 9534 - RNA, 20 nt, Artificial Sequence
  source: /note="Description of Artificial Sequence: Synthetic oligonucleotide"
ccaaauaacccgguauuaaa

SEQ ID NO: 9535 - RNA, 20 nt, Artificial Sequence
  source: /note="Description of Artificial Sequence: Synthetic oligonucleotide"
gaaauccuacccaaauaacc

SEQ ID NO: 9536 - RNA, 20 nt, Artificial Sequence
  source: /note="Description of Artificial Sequence: Synthetic oligonucleotide"
ugaaauccuacccaaauaac

SEQ ID NO: 9537 - RNA, 20 nt, Artificial Sequence
  source: /note="Description of Artificial Sequence: Synthetic oligonucleotide"
augaaauccuacccaaauaa

SEQ ID NO: 9538 - RNA, 20 nt, Artificial Sequence
  source: /note="Description of Artificial Sequence: Synthetic oligonucleotide"
aaugaaauccuacccaaaua

SEQ ID NO: 9539 - RNA, 20 nt, Artificial Sequence
  source: /note="Description of Artificial Sequence: Synthetic oligonucleotide"
aaaaaaaaaaugaaauccua

SEQ ID NO: 9540 - RNA, 20 nt, Artificial Sequence
  source: /note="Description of Artificial Sequence: Synthetic oligonucleotide"
caaaaaaaaaaugaaauccu

SEQ ID NO: 9541 - RNA, 20 nt, Artificial Sequence
  source: /note="Description of Artificial Sequence: Synthetic oligonucleotide"
gaagcaaaaaaaaaaugaaa

SEQ ID NO: 9542 - RNA, 20 nt, Artificial Sequence
  source: /note="Description of Artificial Sequence: Synthetic oligonucleotide"
ucugucagggacuggauauu

SEQ ID NO: 9543 - RNA, 20 nt, Artificial Sequence
  source: /note="Description of Artificial Sequence: Synthetic oligonucleotide"
uucucaucauucaauuagua

SEQ ID NO: 9544 - RNA, 20 nt, Artificial Sequence
  source: /note="Description of Artificial Sequence: Synthetic oligonucleotide"
gcuaaaugcuaaauauacug

SEQ ID NO: 9545 - RNA, 20 nt, Artificial Sequence
  source: /note="Description of Artificial Sequence: Synthetic oligonucleotide"
cauuagaaugacugaaaaug

SEQ ID NO: 9546 - RNA, 20 nt, Artificial Sequence
  source: /note="Description of Artificial Sequence: Synthetic oligonucleotide"
auguuauaauaucuauagua

SEQ ID NO: 9547 - RNA, 20 nt, Artificial Sequence
  source: /note="Description of Artificial Sequence: Synthetic oligonucleotide"
uaacaaauucuucauuuaaa

SEQ ID NO: 9548 - RNA, 20 nt, Artificial Sequence
  source: /note="Description of Artificial Sequence: Synthetic oligonucleotide"
uuaacaaauucuucauuuaa

SEQ ID NO: 9549 - RNA, 20 nt, Artificial Sequence
  source: /note="Description of Artificial Sequence: Synthetic oligonucleotide"
uaguaagugaaagcuuaaua

SEQ ID NO: 9550 - RNA, 20 nt, Artificial Sequence
  source: /note="Description of Artificial Sequence: Synthetic oligonucleotide"
aaaacuuauacugugauuuc

SEQ ID NO: 9551 - RNA, 20 nt, Artificial Sequence
  source: /note="Description of Artificial Sequence: Synthetic oligonucleotide"
uuuaucacuugauaaaacag

SEQ ID NO: 9552 - RNA, 20 nt, Artificial Sequence
  source: /note="Description of Artificial Sequence: Synthetic oligonucleotide"
uacuugguauccucuggauu

SEQ ID NO: 9553 - RNA, 20 nt, Artificial Sequence
  source: /note="Description of Artificial Sequence: Synthetic oligonucleotide"
auaaguuacuugguauccuc

SEQ ID NO: 9554 - RNA, 20 nt, Artificial Sequence
  source: /note="Description of Artificial Sequence: Synthetic oligonucleotide"
aacagaggcaauaaguuacu

SEQ ID NO: 9555 - RNA, 20 nt, Artificial Sequence
  source: /note="Description of Artificial Sequence: Synthetic oligonucleotide"
agagcucuccuacccaacag

SEQ ID NO: 9556 - RNA, 20 nt, Artificial Sequence
  source: /note="Description of Artificial Sequence: Synthetic oligonucleotide"
guaaauuuuagaaggugagg

SEQ ID NO: 9557 - RNA, 20 nt, Artificial Sequence
  source: /note="Description of Artificial Sequence: Synthetic oligonucleotide"
gauguaaauuuuagaaggug

SEQ ID NO: 9558 - RNA, 20 nt, Artificial Sequence
  source: /note="Description of Artificial Sequence: Synthetic oligonucleotide"
gcagagauguaaauuuuaga

SEQ ID NO: 9559 - RNA, 20 nt, Artificial Sequence
  source: /note="Description of Artificial Sequence: Synthetic oligonucleotide"
aguugugagacauaaccacc

SEQ ID NO: 9560 - RNA, 20 nt, Artificial Sequence
  source: /note="Description of Artificial Sequence: Synthetic oligonucleotide"
auauacuguuaaaaaauggu

SEQ ID NO: 9561 - RNA, 20 nt, Artificial Sequence
  source: /note="Description of Artificial Sequence: Synthetic oligonucleotide"
aguaauauacuguuaaaaaa

SEQ ID NO: 9562 - RNA, 20 nt, Artificial Sequence
  source: /note="Description of Artificial Sequence: Synthetic oligonucleotide"
uugcagaauuuacuugaaag

SEQ ID NO: 9563 - RNA, 20 nt, Artificial Sequence
  source: /note="Description of Artificial Sequence: Synthetic oligonucleotide"
uuugcagaauuuacuugaaa

SEQ ID NO: 9564 - RNA, 20 nt, Artificial Sequence
  source: /note="Description of Artificial Sequence: Synthetic oligonucleotide"
cuuugcagaauuuacuugaa

SEQ ID NO: 9565 - RNA, 20 nt, Artificial Sequence
  source: /note="Description of Artificial Sequence: Synthetic oligonucleotide"
augcuucagaacuagaaugc

SEQ ID NO: 9566 - RNA, 20 nt, Artificial Sequence
  source: /note="Description of Artificial Sequence: Synthetic oligonucleotide"
uuuacuggacacuucaaaua

SEQ ID NO: 9567 - RNA, 20 nt, Artificial Sequence
  source: /note="Description of Artificial Sequence: Synthetic oligonucleotide"
auagagcaacuaaaauuuac

SEQ ID NO: 9568 - RNA, 20 nt, Artificial Sequence
  source: /note="Description of Artificial Sequence: Synthetic oligonucleotide"
aagauaguauuuaaauaauu

SEQ ID NO: 9569 - RNA, 20 nt, Artificial Sequence
  source: /note="Description of Artificial Sequence: Synthetic oligonucleotide"
gucacauuuuuuagcuacca

SEQ ID NO: 9570 - RNA, 20 nt, Artificial Sequence
  source: /note="Description of Artificial Sequence: Synthetic oligonucleotide"
uaagccguauggucuuaaag

SEQ ID NO: 9571 - RNA, 20 nt, Artificial Sequence
  source: /note="Description of Artificial Sequence: Synthetic oligonucleotide"
guuaggggaauuaagccgua

SEQ ID NO: 9572 - RNA, 20 nt, Artificial Sequence
  source: /note="Description of Artificial Sequence: Synthetic oligonucleotide"
ugugccaggaguaggguuag

SEQ ID NO: 9573 - RNA, 20 nt, Artificial Sequence
  source: /note="Description of Artificial Sequence: Synthetic oligonucleotide"
cugugccaggaguaggguua

SEQ ID NO: 9574 - RNA, 20 nt, Artificial Sequence
  source: /note="Description of Artificial Sequence: Synthetic oligonucleotide"
ccugugccaggaguaggguu

SEQ ID NO: 9575 - RNA, 20 nt, Artificial Sequence
  source: /note="Description of Artificial Sequence: Synthetic oligonucleotide"
acaagccugugccaggagua

SEQ ID NO: 9576 - RNA, 20 nt, Artificial Sequence
  source: /note="Description of Artificial Sequence: Synthetic oligonucleotide"
cacaagccugugccaggagu

SEQ ID NO: 9577 - RNA, 20 nt, Artificial Sequence
  source: /note="Description of Artificial Sequence: Synthetic oligonucleotide"
uauacacacaagccugugcc

SEQ ID NO: 9578 - RNA, 20 nt, Artificial Sequence
  source: /note="Description of Artificial Sequence: Synthetic oligonucleotide"
ugaaucccaaacacaauaua

SEQ ID NO: 9579 - RNA, 20 nt, Artificial Sequence
  source: /note="Description of Artificial Sequence: Synthetic oligonucleotide"
agguaaguuuaaauaaucau

SEQ ID NO: 9580 - RNA, 20 nt, Artificial Sequence
  source: /note="Description of Artificial Sequence: Synthetic oligonucleotide"
caugcgcuucuaaaagucac

SEQ ID NO: 9581 - RNA, 20 nt, Artificial Sequence
  source: /note="Description of Artificial Sequence: Synthetic oligonucleotide"
uuguuucuguaaacagacua

SEQ ID NO: 9582 - RNA, 20 nt, Artificial Sequence
  source: /note="Description of Artificial Sequence: Synthetic oligonucleotide"
gagauuacaucaaaauuaug

SEQ ID NO: 9583 - RNA, 20 nt, Artificial Sequence
  source: /note="Description of Artificial Sequence: Synthetic oligonucleotide"
aauuauguggcccaagcuau

SEQ ID NO: 9584 - RNA, 20 nt, Artificial Sequence
  source: /note="Description of Artificial Sequence: Synthetic oligonucleotide"
cauuguaaguauauauauuu

SEQ ID NO: 9585 - RNA, 20 nt, Artificial Sequence
  source: /note="Description of Artificial Sequence: Synthetic oligonucleotide"
aaacuauagcuaguuaagac

SEQ ID NO: 9586 - RNA, 20 nt, Artificial Sequence
  source: /note="Description of Artificial Sequence: Synthetic oligonucleotide"
guuaagacagguagaugauu

SEQ ID NO: 9587 - RNA, 20 nt, Artificial Sequence
  source: /note="Description of Artificial Sequence: Synthetic oligonucleotide"
ucagaaaucucucaucauga

SEQ ID NO: 9588 - RNA, 20 nt, Artificial Sequence
  source: /note="Description of Artificial Sequence: Synthetic oligonucleotide"
uaaacacuguguuuagucac

SEQ ID NO: 9589 - RNA, 20 nt, Artificial Sequence
  source: /note="Description of Artificial Sequence: Synthetic oligonucleotide"
aaacacuguguuuagucacu

SEQ ID NO: 9590 - RNA, 20 nt, Artificial Sequence
  source: /note="Description of Artificial Sequence: Synthetic oligonucleotide"
uuuagucacugggaacauaa

SEQ ID NO: 9591 - RNA, 20 nt, Artificial Sequence
  source: /note="Description of Artificial Sequence: Synthetic oligonucleotide"
uuuaagaauuccgucuuugc

SEQ ID NO: 9592 - RNA, 20 nt, Artificial Sequence
  source: /note="Description of Artificial Sequence: Synthetic oligonucleotide"
uuaagaauuccgucuuugcu

SEQ ID NO: 9593 - RNA, 20 nt, Artificial Sequence
  source: /note="Description of Artificial Sequence: Synthetic oligonucleotide"
aauuccgucuuugcugggua

SEQ ID NO: 9594 - RNA, 20 nt, Artificial Sequence
  source: /note="Description of Artificial Sequence: Synthetic oligonucleotide"
uccgucuuugcuggguacgg

SEQ ID NO: 9595 - RNA, 20 nt, Artificial Sequence
  source: /note="Description of Artificial Sequence: Synthetic oligonucleotide"
caccuuuaaucccaacacuu

SEQ ID NO: 9596 - RNA, 20 nt, Artificial Sequence
  source: /note="Description of Artificial Sequence: Synthetic oligonucleotide"
accuuuaaucccaacacuuu

SEQ ID NO: 9597 - RNA, 20 nt, Artificial Sequence
  source: /note="Description of Artificial Sequence: Synthetic oligonucleotide"
uuuaaucccaacacuuuggg

SEQ ID NO: 9598 - RNA, 20 nt, Artificial Sequence
  source: /note="Description of Artificial Sequence: Synthetic oligonucleotide"
cccaacacuuugggaggcca

SEQ ID NO: 9599 - RNA, 20 nt, Artificial Sequence
  source: /note="Description of Artificial Sequence: Synthetic oligonucleotide"
acacuuugggaggccaaggc

SEQ ID NO: 9600 - RNA, 20 nt, Artificial Sequence
  source: /note="Description of Artificial Sequence: Synthetic oligonucleotide"
cuuugggaggccaaggcagg

SEQ ID NO: 9601 - RNA, 20 nt, Artificial Sequence
  source: /note="Description of Artificial Sequence: Synthetic oligonucleotide"
caaggcagguggaucaccug

SEQ ID NO: 9602 - RNA, 20 nt, Artificial Sequence
  source: /note="Description of Artificial Sequence: Synthetic oligonucleotide"
cagguggaucaccugagguc

SEQ ID NO: 9603 - RNA, 20 nt, Artificial Sequence
  source: /note="Description of Artificial Sequence: Synthetic oligonucleotide"
cuagaccagccugaucaaca

SEQ ID NO: 9604 - RNA, 20 nt, Artificial Sequence
  source: /note="Description of Artificial Sequence: Synthetic oligonucleotide"
acuaaaaauacaaaauuagc

SEQ ID NO: 9605 - RNA, 20 nt, Artificial Sequence
  source: /note="Description of Artificial Sequence: Synthetic oligonucleotide"
cuaaaaauacaaaauuagcu

SEQ ID NO: 9606 - RNA, 20 nt, Artificial Sequence
  source: /note="Description of Artificial Sequence: Synthetic oligonucleotide"
aauacaaaauuagcugggug

SEQ ID NO: 9607 - RNA, 20 nt, Artificial Sequence
  source: /note="Description of Artificial Sequence: Synthetic oligonucleotide"
acaaaauuagcugggugugg

SEQ ID NO: 9608 - RNA, 20 nt, Artificial Sequence
  source: /note="Description of Artificial Sequence: Synthetic oligonucleotide"
aauuagcugggugugguggc

SEQ ID NO: 9609 - RNA, 20 nt, Artificial Sequence
  source: /note="Description of Artificial Sequence: Synthetic oligonucleotide"
caccuguaaucccagcuacu

SEQ ID NO: 9610 - RNA, 20 nt, Artificial Sequence
  source: /note="Description of Artificial Sequence: Synthetic oligonucleotide"
uguaaucccagcuacucgga

SEQ ID NO: 9611 - RNA, 20 nt, Artificial Sequence
  source: /note="Description of Artificial Sequence: Synthetic oligonucleotide"
cccagcuacucggaaggcua

SEQ ID NO: 9612 - RNA, 20 nt, Artificial Sequence
  source: /note="Description of Artificial Sequence: Synthetic oligonucleotide"
gcuacucggaaggcuaaggc

SEQ ID NO: 9613 - RNA, 20 nt, Artificial Sequence
  source: /note="Description of Artificial Sequence: Synthetic oligonucleotide"
gcaggagaauagcuugaacc

SEQ ID NO: 9614 - RNA, 20 nt, Artificial Sequence
  source: /note="Description of Artificial Sequence: Synthetic oligonucleotide"
caggagaauagcuugaaccu

SEQ ID NO: 9615 - RNA, 20 nt, Artificial Sequence
  source: /note="Description of Artificial Sequence: Synthetic oligonucleotide"
gagaauagcuugaaccuggg

SEQ ID NO: 9616 - RNA, 20 nt, Artificial Sequence
  source: /note="Description of Artificial Sequence: Synthetic oligonucleotide"
aauagcuugaaccugggagg

SEQ ID NO: 9617 - RNA, 20 nt, Artificial Sequence
  source: /note="Description of Artificial Sequence: Synthetic oligonucleotide"
agcuugaaccugggaggugg

SEQ ID NO: 9618 - RNA, 20 nt, Artificial Sequence
  source: /note="Description of Artificial Sequence: Synthetic oligonucleotide"
aaaccauugcacuccagccu

SEQ ID NO: 9619 - RNA, 20 nt, Artificial Sequence
  source: /note="Description of Artificial Sequence: Synthetic oligonucleotide"
aaaaaaaauucaucuuuaac

SEQ ID NO: 9620 - RNA, 20 nt, Artificial Sequence
  source: /note="Description of Artificial Sequence: Synthetic oligonucleotide"
aaaaaaauucaucuuuaacu

SEQ ID NO: 9621 - RNA, 20 nt, Artificial Sequence
  source: /note="Description of Artificial Sequence: Synthetic oligonucleotide"
aauucaucuuuaacugggug

SEQ ID NO: 9622 - RNA, 20 nt, Artificial Sequence
  source: /note="Description of Artificial Sequence: Synthetic oligonucleotide"
gccuguaaucccagcuaccc

SEQ ID NO: 9623 - RNA, 20 nt, Artificial Sequence
  source: /note="Description of Artificial Sequence: Synthetic oligonucleotide"
ucccagcuacccaggagacc

SEQ ID NO: 9624 - RNA, 20 nt, Artificial Sequence
  source: /note="Description of Artificial Sequence: Synthetic oligonucleotide"
cccaggagaccaggagucug

SEQ ID NO: 9625 - RNA, 20 nt, Artificial Sequence
  source: /note="Description of Artificial Sequence: Synthetic oligonucleotide"
agaccaggagucugaggcug

SEQ ID NO: 9626 - RNA, 20 nt, Artificial Sequence
  source: /note="Description of Artificial Sequence: Synthetic oligonucleotide"
ugcaucacugugcuccaucc

SEQ ID NO: 9627 - RNA, 20 nt, Artificial Sequence
  source: /note="Description of Artificial Sequence: Synthetic oligonucleotide"
gcaucacugugcuccauccu

SEQ ID NO: 9628 - RNA, 20 nt, Artificial Sequence
  source: /note="Description of Artificial Sequence: Synthetic oligonucleotide"
caaaagaauuccuucuuuag

SEQ ID NO: 9629 - RNA, 20 nt, Artificial Sequence
  source: /note="Description of Artificial Sequence: Synthetic oligonucleotide"
uagaauuacacaguuccagc

SEQ ID NO: 9630 - RNA, 20 nt, Artificial Sequence
  source: /note="Description of Artificial Sequence: Synthetic oligonucleotide"
aucuuugaacuuuauucugu

SEQ ID NO: 9631 - RNA, 20 nt, Artificial Sequence
  source: /note="Description of Artificial Sequence: Synthetic oligonucleotide"
uuuauucuguagguaaccau

SEQ ID NO: 9632 - RNA, 20 nt, Artificial Sequence
  source: /note="Description of Artificial Sequence: Synthetic oligonucleotide"
uuauucuguagguaaccauu

SEQ ID NO: 9633 - RNA, 20 nt, Artificial Sequence
  source: /note="Description of Artificial Sequence: Synthetic oligonucleotide"
gggcuguuucaagugugugu

SEQ ID NO: 9634 - RNA, 20 nt, Artificial Sequence
  source: /note="Description of Artificial Sequence: Synthetic oligonucleotide"
ggcuguuucaaguguguguu

SEQ ID NO: 9635 - RNA, 20 nt, Artificial Sequence
  source: /note="Description of Artificial Sequence: Synthetic oligonucleotide"
gcuguuucaaguguguguug

SEQ ID NO: 9636 - RNA, 20 nt, Artificial Sequence
  source: /note="Description of Artificial Sequence: Synthetic oligonucleotide"
uuucaaguguguguugggga

SEQ ID NO: 9637 - RNA, 20 nt, Artificial Sequence
  source: /note="Description of Artificial Sequence: Synthetic oligonucleotide"
aaguguguguuggggaugga

SEQ ID NO: 9638 - RNA, 20 nt, Artificial Sequence
  source: /note="Description of Artificial Sequence: Synthetic oligonucleotide"
aguguguguuggggauggaa

SEQ ID NO: 9639 - RNA, 20 nt, Artificial Sequence
  source: /note="Description of Artificial Sequence: Synthetic oligonucleotide"
auuuacuuaaaagccaagua

SEQ ID NO: 9640 - RNA, 20 nt, Artificial Sequence
  source: /note="Description of Artificial Sequence: Synthetic oligonucleotide"
uuuacuuaaaagccaaguaa

SEQ ID NO: 9641 - RNA, 20 nt, Artificial Sequence
  source: /note="Description of Artificial Sequence: Synthetic oligonucleotide"
aagaaagcuauugcaaucau

SEQ ID NO: 9642 - RNA, 20 nt, Artificial Sequence
  source: /note="Description of Artificial Sequence: Synthetic oligonucleotide"
agaaagcuauugcaaucauu

SEQ ID NO: 9643 - RNA, 20 nt, Artificial Sequence
  source: /note="Description of Artificial Sequence: Synthetic oligonucleotide"
ucauugggcaagagauuuua

SEQ ID NO: 9644 - RNA, 20 nt, Artificial Sequence
  source: /note="Description of Artificial Sequence: Synthetic oligonucleotide"
auuuuaaggaccuaaagaaa

SEQ ID NO: 9645 - RNA, 20 nt, Artificial Sequence
  source: /note="Description of Artificial Sequence: Synthetic oligonucleotide"
uaaggaccuaaagaaauggc

SEQ ID NO: 9646 - RNA, 20 nt, Artificial Sequence
  source: /note="Description of Artificial Sequence: Synthetic oligonucleotide"
uuaaguauguacacuaacua

SEQ ID NO: 9647 - RNA, 20 nt, Artificial Sequence
  source: /note="Description of Artificial Sequence: Synthetic oligonucleotide"
aguauguacacuaacuaagg

SEQ ID NO: 9648 - RNA, 20 nt, Artificial Sequence
  source: /note="Description of Artificial Sequence: Synthetic oligonucleotide"
aagguggagcuuagagaacu

SEQ ID NO: 9649 - RNA, 20 nt, Artificial Sequence
  source: /note="Description of Artificial Sequence: Synthetic oligonucleotide"
gaacuuggugacuagaugua

SEQ ID NO: 9650 - RNA, 20 nt, Artificial Sequence
  source: /note="Description of Artificial Sequence: Synthetic oligonucleotide"
guauggaugagaaaagaauu

SEQ ID NO: 9651 - RNA, 20 nt, Artificial Sequence
  source: /note="Description of Artificial Sequence: Synthetic oligonucleotide"
gauacaacaaauuuccaguu

SEQ ID NO: 9652 - RNA, 20 nt, Artificial Sequence
  source: /note="Description of Artificial Sequence: Synthetic oligonucleotide"
aacaaauuuccaguuuggac

SEQ ID NO: 9653 - RNA, 20 nt, Artificial Sequence
  source: /note="Description of Artificial Sequence: Synthetic oligonucleotide"
uauuaacuaguaucagaaau

SEQ ID NO: 9654 - RNA, 20 nt, Artificial Sequence
  source: /note="Description of Artificial Sequence: Synthetic oligonucleotide"
ugguaagaaauaguaaguuu

SEQ ID NO: 9655 - RNA, 20 nt, Artificial Sequence
  source: /note="Description of Artificial Sequence: Synthetic oligonucleotide"
gguaagaaauaguaaguuuu

SEQ ID NO: 9656 - RNA, 20 nt, Artificial Sequence
  source: /note="Description of Artificial Sequence: Synthetic oligonucleotide"
agaaauaguaaguuuuggga

SEQ ID NO: 9657 - RNA, 20 nt, Artificial Sequence
  source: /note="Description of Artificial Sequence: Synthetic oligonucleotide"
gaaauaguaaguuuugggau

SEQ ID NO: 9658 - RNA, 20 nt, Artificial Sequence
  source: /note="Description of Artificial Sequence: Synthetic oligonucleotide"
aaauaguaaguuuugggaug

SEQ ID NO: 9659 - RNA, 20 nt, Artificial Sequence
  source: /note="Description of Artificial Sequence: Synthetic oligonucleotide"
gggagaagauaucaaaauuu

SEQ ID NO: 9660 - RNA, 20 nt, Artificial Sequence
  source: /note="Description of Artificial Sequence: Synthetic oligonucleotide"
aucaaaauuuuggacaugcu

SEQ ID NO: 9661 - RNA, 20 nt, Artificial Sequence
  source: /note="Description of Artificial Sequence: Synthetic oligonucleotide"
uuuggacaugcuaggcuucu

SEQ ID NO: 9662 - RNA, 20 nt, Artificial Sequence
  source: /note="Description of Artificial Sequence: Synthetic oligonucleotide"
aggcuucuagguuaauuaga

SEQ ID NO: 9663 - RNA, 20 nt, Artificial Sequence
  source: /note="Description of Artificial Sequence: Synthetic oligonucleotide"
gguuaauuagauggagaauc

SEQ ID NO: 9664 - RNA, 20 nt, Artificial Sequence
  source: /note="Description of Artificial Sequence: Synthetic oligonucleotide"
gagaaucaggagaaaaauuc

SEQ ID NO: 9665 - RNA, 20 nt, Artificial Sequence
  source: /note="Description of Artificial Sequence: Synthetic oligonucleotide"
agauuugagagucagaaugc

SEQ ID NO: 9666 - RNA, 20 nt, Artificial Sequence
  source: /note="Description of Artificial Sequence: Synthetic oligonucleotide"
uugagagucagaaugcuggc

SEQ ID NO: 9667 - RNA, 20 nt, Artificial Sequence
  source: /note="Description of Artificial Sequence: Synthetic oligonucleotide"
ggacuuaaaguugaauacau

SEQ ID NO: 9668 - RNA, 20 nt, Artificial Sequence
  source: /note="Description of Artificial Sequence: Synthetic oligonucleotide"
guugaauacauaggaaugaa

SEQ ID NO: 9669 - RNA, 20 nt, Artificial Sequence
  source: /note="Description of Artificial Sequence: Synthetic oligonucleotide"
gaauacauaggaaugaaagg

SEQ ID NO: 9670 - RNA, 20 nt, Artificial Sequence
  source: /note="Description of Artificial Sequence: Synthetic oligonucleotide"
ucaaaguagagauuauaaag

SEQ ID NO: 9671 - RNA, 20 nt, Artificial Sequence
  source: /note="Description of Artificial Sequence: Synthetic oligonucleotide"
agagauuauaaagaggacaa

SEQ ID NO: 9672 - RNA, 20 nt, Artificial Sequence
  source: /note="Description of Artificial Sequence: Synthetic oligonucleotide"
gagauuauaaagaggacaaa

SEQ ID NO: 9673 - RNA, 20 nt, Artificial Sequence
  source: /note="Description of Artificial Sequence: Synthetic oligonucleotide"
agaggacaaagggcugauga

SEQ ID NO: 9674 - RNA, 20 nt, Artificial Sequence
  source: /note="Description of Artificial Sequence: Synthetic oligonucleotide"
gaggacaaagggcugaugau

SEQ ID NO: 9675 - RNA, 20 nt, Artificial Sequence
  source: /note="Description of Artificial Sequence: Synthetic oligonucleotide"
aagggcugaugaugggauuc

SEQ ID NO: 9676 - RNA, 20 nt, Artificial Sequence
  source: /note="Description of Artificial Sequence: Synthetic oligonucleotide"
cuggagccaucaaucauuuu

SEQ ID NO: 9677 - RNA, 20 nt, Artificial Sequence
  source: /note="Description of Artificial Sequence: Synthetic oligonucleotide"
ucaaucauuuuaggcaugag

SEQ ID NO: 9678 - RNA, 20 nt, Artificial Sequence
  source: /note="Description of Artificial Sequence: Synthetic oligonucleotide"
aucauuuuaggcaugagugg

SEQ ID NO: 9679 - RNA, 20 nt, Artificial Sequence
  source: /note="Description of Artificial Sequence: Synthetic oligonucleotide"
gaagccaaugaaguaagaac

SEQ ID NO: 9680 - RNA, 20 nt, Artificial Sequence
  source: /note="Description of Artificial Sequence: Synthetic oligonucleotide"
aagccaaugaaguaagaacu

SEQ ID NO: 9681 - RNA, 20 nt, Artificial Sequence
  source: /note="Description of Artificial Sequence: Synthetic oligonucleotide"
agccaaugaaguaagaacug

SEQ ID NO: 9682 - RNA, 20 nt, Artificial Sequence
  source: /note="Description of Artificial Sequence: Synthetic oligonucleotide"
gccaaugaaguaagaacugg

SEQ ID NO: 9683 - RNA, 20 nt, Artificial Sequence
  source: /note="Description of Artificial Sequence: Synthetic oligonucleotide"
aaugaaguaagaacuggggg

SEQ ID NO: 9684 - RNA, 20 nt, Artificial Sequence
  source: /note="Description of Artificial Sequence: Synthetic oligonucleotide"
augaaguaagaacuggggga

SEQ ID NO: 9685 - RNA, 20 nt, Artificial Sequence
  source: /note="Description of Artificial Sequence: Synthetic oligonucleotide"
gggaguagaagaaauguagu

SEQ ID NO: 9686 - RNA, 20 nt, Artificial Sequence
  source: /note="Description of Artificial Sequence: Synthetic oligonucleotide"
uguaguaggaaaagugaaag

SEQ ID NO: 9687 - RNA, 20 nt, Artificial Sequence
  source: /note="Description of Artificial Sequence: Synthetic oligonucleotide"
guaguaggaaaagugaaaga

SEQ ID NO: 9688 - RNA, 20 nt, Artificial Sequence
  source: /note="Description of Artificial Sequence: Synthetic oligonucleotide"
ggaaaagugaaagagggaga

SEQ ID NO: 9689 - RNA, 20 nt, Artificial Sequence
  source: /note="Description of Artificial Sequence: Synthetic oligonucleotide"
aagugaaagagggagaugga

SEQ ID NO: 9690 - RNA, 20 nt, Artificial Sequence
  source: /note="Description of Artificial Sequence: Synthetic oligonucleotide"
gaaagagggagauggaugga

SEQ ID NO: 9691 - RNA, 20 nt, Artificial Sequence
  source: /note="Description of Artificial Sequence: Synthetic oligonucleotide"
agagggagauggauggaugg

SEQ ID NO: 9692 - RNA, 20 nt, Artificial Sequence
  source: /note="Description of Artificial Sequence: Synthetic oligonucleotide"
auggauggauggaggaaagc

SEQ ID NO: 9693 - RNA, 20 nt, Artificial Sequence
  source: /note="Description of Artificial Sequence: Synthetic oligonucleotide"
acacccagagcagaguauac

SEQ ID NO: 9694 - RNA, 20 nt, Artificial Sequence
  source: /note="Description of Artificial Sequence: Synthetic oligonucleotide"
gcagaguauacaggagcaau

SEQ ID NO: 9695 - RNA, 20 nt, Artificial Sequence
  source: /note="Description of Artificial Sequence: Synthetic oligonucleotide"
guauacaggagcaauaggua

SEQ ID NO: 9696 - RNA, 20 nt, Artificial Sequence
  source: /note="Description of Artificial Sequence: Synthetic oligonucleotide"
uauacaggagcaauagguau

SEQ ID NO: 9697 - RNA, 20 nt, Artificial Sequence
  source: /note="Description of Artificial Sequence: Synthetic oligonucleotide"
auacaggagcaauagguaug

SEQ ID NO: 9698 - RNA, 20 nt, Artificial Sequence
  source: /note="Description of Artificial Sequence: Synthetic oligonucleotide"
gagcaauagguauggggcuc

SEQ ID NO: 9699 - RNA, 20 nt, Artificial Sequence
  source: /note="Description of Artificial Sequence: Synthetic oligonucleotide"
agcaauagguauggggcucu

SEQ ID NO: 9700 - RNA, 20 nt, Artificial Sequence
  source: /note="Description of Artificial Sequence: Synthetic oligonucleotide"
auagguauggggcucuggga

SEQ ID NO: 9701 - RNA, 20 nt, Artificial Sequence
  source: /note="Description of Artificial Sequence: Synthetic oligonucleotide"
uagguauggggcucugggau

SEQ ID NO: 9702 - RNA, 20 nt, Artificial Sequence
  source: /note="Description of Artificial Sequence: Synthetic oligonucleotide"
gauaauauuaaagacucucg

SEQ ID NO: 9703 - RNA, 20 nt, Artificial Sequence
  source: /note="Description of Artificial Sequence: Synthetic oligonucleotide"
auaauauuaaagacucucgu

SEQ ID NO: 9704 - RNA, 20 nt, Artificial Sequence
  source: /note="Description of Artificial Sequence: Synthetic oligonucleotide"
auuaguuuacacagcagaca

SEQ ID NO: 9705 - RNA, 20 nt, Artificial Sequence
  source: /note="Description of Artificial Sequence: Synthetic oligonucleotide"
uuacacagcagacauggaca

SEQ ID NO: 9706 - RNA, 20 nt, Artificial Sequence
  source: /note="Description of Artificial Sequence: Synthetic oligonucleotide"
uacacagcagacauggacaa

SEQ ID NO: 9707 - RNA, 20 nt, Artificial Sequence
  source: /note="Description of Artificial Sequence: Synthetic oligonucleotide"
gcuacucuucuuuuccacug

SEQ ID NO: 9708 - RNA, 20 nt, Artificial Sequence
  source: /note="Description of Artificial Sequence: Synthetic oligonucleotide"
caaacauuuuuuuuuuuuuu

SEQ ID NO: 9709 - RNA, 20 nt, Artificial Sequence
  source: /note="Description of Artificial Sequence: Synthetic oligonucleotide"
uuuuuugguucgaacaauag

SEQ ID NO: 9710 - RNA, 20 nt, Artificial Sequence
  source: /note="Description of Artificial Sequence: Synthetic oligonucleotide"
aauagaggcaaauuaaacga

SEQ ID NO: 9711 - RNA, 20 nt, Artificial Sequence
  source: /note="Description of Artificial Sequence: Synthetic oligonucleotide"
uuuuaaacacuauuaauagu

SEQ ID NO: 9712 - RNA, 20 nt, Artificial Sequence
  source: /note="Description of Artificial Sequence: Synthetic oligonucleotide"
agcuaguaucacaaaguaua

SEQ ID NO: 9713 - RNA, 20 nt, Artificial Sequence
  source: /note="Description of Artificial Sequence: Synthetic oligonucleotide"
uauguugcuagauuuaaagu

SEQ ID NO: 9714 - RNA, 20 nt, Artificial Sequence
  source: /note="Description of Artificial Sequence: Synthetic oligonucleotide"
auguugcuagauuuaaaguu

SEQ ID NO: 9715 - RNA, 20 nt, Artificial Sequence
  source: /note="Description of Artificial Sequence: Synthetic oligonucleotide"
cuauuaaaugaauuuuuaau

SEQ ID NO: 9716 - RNA, 20 nt, Artificial Sequence
  source: /note="Description of Artificial Sequence: Synthetic oligonucleotide"
aauaggugcuguuaaucaaa

SEQ ID NO: 9717 - RNA, 20 nt, Artificial Sequence
  source: /note="Description of Artificial Sequence: Synthetic oligonucleotide"
uaaucaaauggcuuuacuug

SEQ ID NO: 9718 - RNA, 20 nt, Artificial Sequence
  source: /note="Description of Artificial Sequence: Synthetic oligonucleotide"
ugcucccuugauucuuauua

SEQ ID NO: 9719 - RNA, 20 nt, Artificial Sequence
  source: /note="Description of Artificial Sequence: Synthetic oligonucleotide"
agucaauuaauaguuguaaa

SEQ ID NO: 9720 - RNA, 20 nt, Artificial Sequence
  source: /note="Description of Artificial Sequence: Synthetic oligonucleotide"
auggaugagaugcuucugaa

SEQ ID NO: 9721 - RNA, 20 nt, Artificial Sequence
  source: /note="Description of Artificial Sequence: Synthetic oligonucleotide"
uaaaauauuuuuauauugca

SEQ ID NO: 9722 - RNA, 20 nt, Artificial Sequence
  source: /note="Description of Artificial Sequence: Synthetic oligonucleotide"
auauuuuuauauugcauggu

SEQ ID NO: 9723 - RNA, 20 nt, Artificial Sequence
  source: /note="Description of Artificial Sequence: Synthetic oligonucleotide"
uauugcaugguagguacuau

SEQ ID NO: 9724 - RNA, 20 nt, Artificial Sequence
  source: /note="Description of Artificial Sequence: Synthetic oligonucleotide"
ugauguuuccacacaguaca

SEQ ID NO: 9725 - RNA, 20 nt, Artificial Sequence
  source: /note="Description of Artificial Sequence: Synthetic oligonucleotide"
gauguuuccacacaguacac

SEQ ID NO: 9726 - RNA, 20 nt, Artificial Sequence
  source: /note="Description of Artificial Sequence: Synthetic oligonucleotide"
ucuuauugcuaaaguuuagu

SEQ ID NO: 9727 - RNA, 20 nt, Artificial Sequence
  source: /note="Description of Artificial Sequence: Synthetic oligonucleotide"
caucucuucugucaguccca

SEQ ID NO: 9728 - RNA, 20 nt, Artificial Sequence
  source: /note="Description of Artificial Sequence: Synthetic oligonucleotide"
cuauccaguagacauauauu

SEQ ID NO: 9729 - RNA, 20 nt, Artificial Sequence
  source: /note="Description of Artificial Sequence: Synthetic oligonucleotide"
aacaguagaccugaaauagc

SEQ ID NO: 9730 - RNA, 20 nt, Artificial Sequence
  source: /note="Description of Artificial Sequence: Synthetic oligonucleotide"
aagagagcuuucuaugaaga

SEQ ID NO: 9731 - RNA, 20 nt, Artificial Sequence
  source: /note="Description of Artificial Sequence: Synthetic oligonucleotide"
uuuaugcuguucaguguaau

SEQ ID NO: 9732 - RNA, 20 nt, Artificial Sequence
  source: /note="Description of Artificial Sequence: Synthetic oligonucleotide"
uaauaggcacuagccacaug

SEQ ID NO: 9733 - RNA, 20 nt, Artificial Sequence
  source: /note="Description of Artificial Sequence: Synthetic oligonucleotide"
auuauuuaacaguugauacg

SEQ ID NO: 9734 - RNA, 20 nt, Artificial Sequence
  source: /note="Description of Artificial Sequence: Synthetic oligonucleotide"
uuaacacaaacagccacaug

SEQ ID NO: 9735 - RNA, 20 nt, Artificial Sequence
  source: /note="Description of Artificial Sequence: Synthetic oligonucleotide"
aaacagccacauguggauaa

SEQ ID NO: 9736 - RNA, 20 nt, Artificial Sequence
  source: /note="Description of Artificial Sequence: Synthetic oligonucleotide"
uugucuuccagacauuuaga

SEQ ID NO: 9737 - RNA, 20 nt, Artificial Sequence
  source: /note="Description of Artificial Sequence: Synthetic oligonucleotide"
uucauucacaaaauccugca

SEQ ID NO: 9738 - RNA, 20 nt, Artificial Sequence
  source: /note="Description of Artificial Sequence: Synthetic oligonucleotide"
aauccugcaugguauuuuuu

SEQ ID NO: 9739 - RNA, 20 nt, Artificial Sequence
  source: /note="Description of Artificial Sequence: Synthetic oligonucleotide"
gcaugguauuuuuuaggaga

SEQ ID NO: 9740 - RNA, 20 nt, Artificial Sequence
  source: /note="Description of Artificial Sequence: Synthetic oligonucleotide"
agaccacagcaugaacugaa

SEQ ID NO: 9741 - RNA, 20 nt, Artificial Sequence
  source: /note="Description of Artificial Sequence: Synthetic oligonucleotide"
caucuauguuaaagaguagu

SEQ ID NO: 9742 - RNA, 20 nt, Artificial Sequence
  source: /note="Description of Artificial Sequence: Synthetic oligonucleotide"
uugguaccuucauuuuccuu

SEQ ID NO: 9743 - RNA, 20 nt, Artificial Sequence
  source: /note="Description of Artificial Sequence: Synthetic oligonucleotide"
ccuuuggccaaaguuuuaug

SEQ ID NO: 9744 - RNA, 20 nt, Artificial Sequence
  source: /note="Description of Artificial Sequence: Synthetic oligonucleotide"
aguucaucuucuagccauga

SEQ ID NO: 9745 - RNA, 20 nt, Artificial Sequence
  source: /note="Description of Artificial Sequence: Synthetic oligonucleotide"
ugacaaaauauaugaaacaa

SEQ ID NO: 9746 - RNA, 20 nt, Artificial Sequence
  source: /note="Description of Artificial Sequence: Synthetic oligonucleotide"
auaagaaauucaagagacag

SEQ ID NO: 9747 - RNA, 20 nt, Artificial Sequence
  source: /note="Description of Artificial Sequence: Synthetic oligonucleotide"
gacaguggcaccagagagaa

SEQ ID NO: 9748 - RNA, 20 nt, Artificial Sequence
  source: /note="Description of Artificial Sequence: Synthetic oligonucleotide"
cagagagaaaggaaguaaaa

SEQ ID NO: 9749 - RNA, 20 nt, Artificial Sequence
  source: /note="Description of Artificial Sequence: Synthetic oligonucleotide"
uacuuccugaagagaguauu

SEQ ID NO: 9750 - RNA, 20 nt, Artificial Sequence
  source: /note="Description of Artificial Sequence: Synthetic oligonucleotide"
uaggcuccaguguagccagu

SEQ ID NO: 9751 - RNA, 20 nt, Artificial Sequence
  source: /note="Description of Artificial Sequence: Synthetic oligonucleotide"
ccagccuuaucucuguauua

SEQ ID NO: 9752 - RNA, 20 nt, Artificial Sequence
  source: /note="Description of Artificial Sequence: Synthetic oligonucleotide"
aggagacaaaguucaaaauu

SEQ ID NO: 9753 - RNA, 20 nt, Artificial Sequence
  source: /note="Description of Artificial Sequence: Synthetic oligonucleotide"
acaaaguucaaaauuuggag

SEQ ID NO: 9754 - RNA, 20 nt, Artificial Sequence
  source: /note="Description of Artificial Sequence: Synthetic oligonucleotide"
uucaaaauuuggagaggcca

SEQ ID NO: 9755 - RNA, 20 nt, Artificial Sequence
  source: /note="Description of Artificial Sequence: Synthetic oligonucleotide"
cacuauucagaauaucagag

SEQ ID NO: 9756 - RNA, 20 nt, Artificial Sequence
  source: /note="Description of Artificial Sequence: Synthetic oligonucleotide"
aaagcuccagagaccugcag

SEQ ID NO: 9757 - RNA, 20 nt, Artificial Sequence
  source: /note="Description of Artificial Sequence: Synthetic oligonucleotide"
aagcuccagagaccugcaga

SEQ ID NO: 9758 - RNA, 20 nt, Artificial Sequence
  source: /note="Description of Artificial Sequence: Synthetic oligonucleotide"
ugcaugugaaaaaacugcca

SEQ ID NO: 9759 - RNA, 20 nt, Artificial Sequence
  source: /note="Description of Artificial Sequence: Synthetic oligonucleotide"
gugaaaaaacugccaaggcu

SEQ ID NO: 9760 - RNA, 20 nt, Artificial Sequence
  source: /note="Description of Artificial Sequence: Synthetic oligonucleotide"
aaaaacugccaaggcuaggu

SEQ ID NO: 9761 - RNA, 20 nt, Artificial Sequence
  source: /note="Description of Artificial Sequence: Synthetic oligonucleotide"
aaaacugccaaggcuaggua

SEQ ID NO: 9762 - RNA, 20 nt, Artificial Sequence
  source: /note="Description of Artificial Sequence: Synthetic oligonucleotide"
aaagaaccaucagaagaagc

SEQ ID NO: 9763 - RNA, 20 nt, Artificial Sequence
  source: /note="Description of Artificial Sequence: Synthetic oligonucleotide"
auaaucccuugaucucacac

SEQ ID NO: 9764 - RNA, 20 nt, Artificial Sequence
  source: /note="Description of Artificial Sequence: Synthetic oligonucleotide"
ccuugaucucacacaggacc

SEQ ID NO: 9765 - RNA, 20 nt, Artificial Sequence
  source: /note="Description of Artificial Sequence: Synthetic oligonucleotide"
ucuugaucauaccagccaga

SEQ ID NO: 9766 - RNA, 20 nt, Artificial Sequence
  source: /note="Description of Artificial Sequence: Synthetic oligonucleotide"
uauucauaauuguauugccu

SEQ ID NO: 9767 - RNA, 20 nt, Artificial Sequence
  source: /note="Description of Artificial Sequence: Synthetic oligonucleotide"
cuugguaguagaaguaaauu

SEQ ID NO: 9768 - RNA, 20 nt, Artificial Sequence
  source: /note="Description of Artificial Sequence: Synthetic oligonucleotide"
gcuuaaaaugaaaacauaga

SEQ ID NO: 9769 - RNA, 20 nt, Artificial Sequence
  source: /note="Description of Artificial Sequence: Synthetic oligonucleotide"
cuuaaaaugaaaacauagaa

SEQ ID NO: 9770 - RNA, 20 nt, Artificial Sequence
  source: /note="Description of Artificial Sequence: Synthetic oligonucleotide"
aaaaaaaaaaucuaccaaca

SEQ ID NO: 9771 - RNA, 20 nt, Artificial Sequence
  source: /note="Description of Artificial Sequence: Synthetic oligonucleotide"
gcauuccaucagaaaauaca

SEQ ID NO: 9772 - RNA, 20 nt, Artificial Sequence
  source: /note="Description of Artificial Sequence: Synthetic oligonucleotide"
aaagaaaauauaaccuuuac

SEQ ID NO: 9773 - RNA, 20 nt, Artificial Sequence
  source: /note="Description of Artificial Sequence: Synthetic oligonucleotide"
aagaaaauauaaccuuuacu

SEQ ID NO: 9774 - RNA, 20 nt, Artificial Sequence
  source: /note="Description of Artificial Sequence: Synthetic oligonucleotide"
agaaaauauaaccuuuacug

SEQ ID NO: 9775 - RNA, 20 nt, Artificial Sequence
  source: /note="Description of Artificial Sequence: Synthetic oligonucleotide"
uauaaccuuuacuggggaac

SEQ ID NO: 9776 - RNA, 20 nt, Artificial Sequence
  source: /note="Description of Artificial Sequence: Synthetic oligonucleotide"
uguaaauaaguucauuaaaa

SEQ ID NO: 9777 - RNA, 20 nt, Artificial Sequence
  source: /note="Description of Artificial Sequence: Synthetic oligonucleotide"
uucauauguuaaaaugccag

SEQ ID NO: 9778 - RNA, 20 nt, Artificial Sequence
  source: /note="Description of Artificial Sequence: Synthetic oligonucleotide"
aggaaagcaugagagugaua

SEQ ID NO: 9779 - RNA, 20 nt, Artificial Sequence
  source: /note="Description of Artificial Sequence: Synthetic oligonucleotide"
aucuagauuaaaaauacacu

SEQ ID NO: 9780 - RNA, 20 nt, Artificial Sequence
  source: /note="Description of Artificial Sequence: Synthetic oligonucleotide"
uagauuaaaaauacacuagg

SEQ ID NO: 9781 - RNA, 20 nt, Artificial Sequence
  source: /note="Description of Artificial Sequence: Synthetic oligonucleotide"
uaggcggaauuaacagauua

SEQ ID NO: 9782 - RNA, 20 nt, Artificial Sequence
  source: /note="Description of Artificial Sequence: Synthetic oligonucleotide"
uacacuaauauauguguaau

SEQ ID NO: 9783 - RNA, 20 nt, Artificial Sequence
  source: /note="Description of Artificial Sequence: Synthetic oligonucleotide"
uguguaauuggaguaccaga

SEQ ID NO: 9784 - RNA, 20 nt, Artificial Sequence
  source: /note="Description of Artificial Sequence: Synthetic oligonucleotide"
guaauuggaguaccagaagg

SEQ ID NO: 9785 - RNA, 20 nt, Artificial Sequence
  source: /note="Description of Artificial Sequence: Synthetic oligonucleotide"
auuggaguaccagaaggagg

SEQ ID NO: 9786 - RNA, 20 nt, Artificial Sequence
  source: /note="Description of Artificial Sequence: Synthetic oligonucleotide"
uuggaguaccagaaggaggu

SEQ ID NO: 9787 - RNA, 20 nt, Artificial Sequence
  source: /note="Description of Artificial Sequence: Synthetic oligonucleotide"
aaaaauauuuaaagaaacaa

SEQ ID NO: 9788 - RNA, 20 nt, Artificial Sequence
  source: /note="Description of Artificial Sequence: Synthetic oligonucleotide"
ugauaaagagaaacucagaa

SEQ ID NO: 9789 - RNA, 20 nt, Artificial Sequence
  source: /note="Description of Artificial Sequence: Synthetic oligonucleotide"
gagaaacucagaaaggcaaa

SEQ ID NO: 9790 - RNA, 20 nt, Artificial Sequence
  source: /note="Description of Artificial Sequence: Synthetic oligonucleotide"
gaaaggcaaauggagaaaaa

SEQ ID NO: 9791 - RNA, 20 nt, Artificial Sequence
  source: /note="Description of Artificial Sequence: Synthetic oligonucleotide"
aaaaaaggacauauuacacu

SEQ ID NO: 9792 - RNA, 20 nt, Artificial Sequence
  source: /note="Description of Artificial Sequence: Synthetic oligonucleotide"
aaaggacauauuacacuagg

SEQ ID NO: 9793 - RNA, 20 nt, Artificial Sequence
  source: /note="Description of Artificial Sequence: Synthetic oligonucleotide"
aaggacauauuacacuaggu

SEQ ID NO: 9794 - RNA, 20 nt, Artificial Sequence
  source: /note="Description of Artificial Sequence: Synthetic oligonucleotide"
uaggugggaaaaaauaagac

SEQ ID NO: 9795 - RNA, 20 nt, Artificial Sequence
  source: /note="Description of Artificial Sequence: Synthetic oligonucleotide"
aggagacuucauucagaaaa

SEQ ID NO: 9796 - RNA, 20 nt, Artificial Sequence
  source: /note="Description of Artificial Sequence: Synthetic oligonucleotide"
aauguuaaacgaaauccuuc

SEQ ID NO: 9797 - RNA, 20 nt, Artificial Sequence
  source: /note="Description of Artificial Sequence: Synthetic oligonucleotide"
aguaucaaaaauaguaaaca

SEQ ID NO: 9798 - RNA, 20 nt, Artificial Sequence
  source: /note="Description of Artificial Sequence: Synthetic oligonucleotide"
uauauuaacaauguauuaug

SEQ ID NO: 9799 - RNA, 20 nt, Artificial Sequence
  source: /note="Description of Artificial Sequence: Synthetic oligonucleotide"
aacacguagaaguagcacag

SEQ ID NO: 9800 - RNA, 20 nt, Artificial Sequence
  source: /note="Description of Artificial Sequence: Synthetic oligonucleotide"
uagaaguagcacagaggcug

SEQ ID NO: 9801 - RNA, 20 nt, Artificial Sequence
  source: /note="Description of Artificial Sequence: Synthetic oligonucleotide"
uaaaguacuuauacgauaug

SEQ ID NO: 9802 - RNA, 20 nt, Artificial Sequence
  source: /note="Description of Artificial Sequence: Synthetic oligonucleotide"
uacuuauacgauauguggac

SEQ ID NO: 9803 - RNA, 20 nt, Artificial Sequence
  source: /note="Description of Artificial Sequence: Synthetic oligonucleotide"
acuuauacgauauguggacu

SEQ ID NO: 9804 - RNA, 20 nt, Artificial Sequence
  source: /note="Description of Artificial Sequence: Synthetic oligonucleotide"
uguggacuggguauauuacu

SEQ ID NO: 9805 - RNA, 20 nt, Artificial Sequence
  source: /note="Description of Artificial Sequence: Synthetic oligonucleotide"
aaauguuuuuaaaaauauau

SEQ ID NO: 9806 - RNA, 20 nt, Artificial Sequence
  source: /note="Description of Artificial Sequence: Synthetic oligonucleotide"
aaauaaaacaaauagcaaga

SEQ ID NO: 9807 - RNA, 20 nt, Artificial Sequence
  source: /note="Description of Artificial Sequence: Synthetic oligonucleotide"
acaaccacauuaaauguaaa

SEQ ID NO: 9808 - RNA, 20 nt, Artificial Sequence
  source: /note="Description of Artificial Sequence: Synthetic oligonucleotide"
uuuuaacaccccuaauuaua

SEQ ID NO: 9809 - RNA, 20 nt, Artificial Sequence
  source: /note="Description of Artificial Sequence: Synthetic oligonucleotide"
ugauguugaaaagacauaac

SEQ ID NO: 9810 - RNA, 20 nt, Artificial Sequence
  source: /note="Description of Artificial Sequence: Synthetic oligonucleotide"
aaaaauaugauuauugcagu

SEQ ID NO: 9811 - RNA, 20 nt, Artificial Sequence
  source: /note="Description of Artificial Sequence: Synthetic oligonucleotide"
uaauauucaacauucauaaa

SEQ ID NO: 9812 - RNA, 20 nt, Artificial Sequence
  source: /note="Description of Artificial Sequence: Synthetic oligonucleotide"
caaccuauuaaauacauaaa

SEQ ID NO: 9813 - RNA, 20 nt, Artificial Sequence
  source: /note="Description of Artificial Sequence: Synthetic oligonucleotide"
aaagcuaaugcuauacuuag

SEQ ID NO: 9814 - RNA, 20 nt, Artificial Sequence
  source: /note="Description of Artificial Sequence: Synthetic oligonucleotide"
aauacuugaccccuaagaua

SEQ ID NO: 9815 - RNA, 20 nt, Artificial Sequence
  source: /note="Description of Artificial Sequence: Synthetic oligonucleotide"
aaauuuuagaaagugcagua

SEQ ID NO: 9816 - RNA, 20 nt, Artificial Sequence
  source: /note="Description of Artificial Sequence: Synthetic oligonucleotide"
auaaauaaagcagucaagau

SEQ ID NO: 9817 - RNA, 20 nt, Artificial Sequence
  source: /note="Description of Artificial Sequence: Synthetic oligonucleotide"
uaaauaaagcagucaagauu

SEQ ID NO: 9818 - RNA, 20 nt, Artificial Sequence
  source: /note="Description of Artificial Sequence: Synthetic oligonucleotide"
uaaagcagucaagauugggu

SEQ ID NO: 9819 - RNA, 20 nt, Artificial Sequence
  source: /note="Description of Artificial Sequence: Synthetic oligonucleotide"
aaauguauaagauuauauac

SEQ ID NO: 9820 - RNA, 20 nt, Artificial Sequence
  source: /note="Description of Artificial Sequence: Synthetic oligonucleotide"
uuauagaaaacuucaguaac

SEQ ID NO: 9821 - RNA, 20 nt, Artificial Sequence
  source: /note="Description of Artificial Sequence: Synthetic oligonucleotide"
ggagagauacacuauguuaa

SEQ ID NO: 9822 - RNA, 20 nt, Artificial Sequence
  source: /note="Description of Artificial Sequence: Synthetic oligonucleotide"
ugauguuucaaaaccccagc

SEQ ID NO: 9823 - RNA, 20 nt, Artificial Sequence
  source: /note="Description of Artificial Sequence: Synthetic oligonucleotide"
agcagguuuuuugaaagaau

SEQ ID NO: 9824 - RNA, 20 nt, Artificial Sequence
  source: /note="Description of Artificial Sequence: Synthetic oligonucleotide"
uuugaaagaauuggacaaga

SEQ ID NO: 9825 - RNA, 20 nt, Artificial Sequence
  source: /note="Description of Artificial Sequence: Synthetic oligonucleotide"
ggcuguaaaauauauauacu

SEQ ID NO: 9826 - RNA, 20 nt, Artificial Sequence
  source: /note="Description of Artificial Sequence: Synthetic oligonucleotide"
auauauacuuggaaaugcaa

SEQ ID NO: 9827 - RNA, 20 nt, Artificial Sequence
  source: /note="Description of Artificial Sequence: Synthetic oligonucleotide"
acuuggaaaugcaaaggacu

SEQ ID NO: 9828 - RNA, 20 nt, Artificial Sequence
  source: /note="Description of Artificial Sequence: Synthetic oligonucleotide"
ucaaauaauauuuuaaaaua

SEQ ID NO: 9829 - RNA, 20 nt, Artificial Sequence
  source: /note="Description of Artificial Sequence: Synthetic oligonucleotide"
caaauaauauuuuaaaauaa

SEQ ID NO: 9830 - RNA, 20 nt, Artificial Sequence
  source: /note="Description of Artificial Sequence: Synthetic oligonucleotide"
auuugagacuauauauugca

SEQ ID NO: 9831 - RNA, 20 nt, Artificial Sequence
  source: /note="Description of Artificial Sequence: Synthetic oligonucleotide"
aagacaguuugauauugccc

SEQ ID NO: 9832 - RNA, 20 nt, Artificial Sequence
  source: /note="Description of Artificial Sequence: Synthetic oligonucleotide"
uugauauugcccaggcgcag

SEQ ID NO: 9833 - RNA, 20 nt, Artificial Sequence
  source: /note="Description of Artificial Sequence: Synthetic oligonucleotide"
gccuguaauuccagcacuuu

SEQ ID NO: 9834 - RNA, 20 nt, Artificial Sequence
  source: /note="Description of Artificial Sequence: Synthetic oligonucleotide"
uguaauuccagcacuuucgg

SEQ ID NO: 9835 - RNA, 20 nt, Artificial Sequence
  source: /note="Description of Artificial Sequence: Synthetic oligonucleotide"
uccagcacuuucggaggccg

SEQ ID NO: 9836 - RNA, 20 nt, Artificial Sequence
  source: /note="Description of Artificial Sequence: Synthetic oligonucleotide"
agcacuuucggaggccgagg

SEQ ID NO: 9837 - RNA, 20 nt, Artificial Sequence
  source: /note="Description of Artificial Sequence: Synthetic oligonucleotide"
gcacuuucggaggccgaggu

SEQ ID NO: 9838 - RNA, 20 nt, Artificial Sequence
  source: /note="Description of Artificial Sequence: Synthetic oligonucleotide"
cuuucggaggccgagguggg

SEQ ID NO: 9839 - RNA, 20 nt, Artificial Sequence
  source: /note="Description of Artificial Sequence: Synthetic oligonucleotide"
cgagguggguggaucacuug

SEQ ID NO: 9840 - RNA, 20 nt, Artificial Sequence
  source: /note="Description of Artificial Sequence: Synthetic oligonucleotide"
uggguggaucacuugaggcc

SEQ ID NO: 9841 - RNA, 20 nt, Artificial Sequence
  source: /note="Description of Artificial Sequence: Synthetic oligonucleotide"
caggaguuuugagaccagcc

SEQ ID NO: 9842 - RNA, 20 nt, Artificial Sequence
  source: /note="Description of Artificial Sequence: Synthetic oligonucleotide"
ugagaccagccuggccaaca

SEQ ID NO: 9843 - RNA, 20 nt, Artificial Sequence
  source: /note="Description of Artificial Sequence: Synthetic oligonucleotide"
auaaaaauacaaaaaauuac

SEQ ID NO: 9844 - RNA, 20 nt, Artificial Sequence
  source: /note="Description of Artificial Sequence: Synthetic oligonucleotide"
uaaaaauacaaaaaauuacu

SEQ ID NO: 9845 - RNA, 20 nt, Artificial Sequence
  source: /note="Description of Artificial Sequence: Synthetic oligonucleotide"
aaaaauacaaaaaauuacug

SEQ ID NO: 9846 - RNA, 20 nt, Artificial Sequence
  source: /note="Description of Artificial Sequence: Synthetic oligonucleotide"
uacaaaaaauuacuggggca

SEQ ID NO: 9847 - RNA, 20 nt, Artificial Sequence
  source: /note="Description of Artificial Sequence: Synthetic oligonucleotide"
aaaaaauuacuggggcaugg

SEQ ID NO: 9848 - RNA, 20 nt, Artificial Sequence
  source: /note="Description of Artificial Sequence: Synthetic oligonucleotide"
ugcuuauagucccagcugcu

SEQ ID NO: 9849 - RNA, 20 nt, Artificial Sequence
  source: /note="Description of Artificial Sequence: Synthetic oligonucleotide"
gcuuauagucccagcugcuu

SEQ ID NO: 9850 - RNA, 20 nt, Artificial Sequence
  source: /note="Description of Artificial Sequence: Synthetic oligonucleotide"
uauagucccagcugcuuggg

SEQ ID NO: 9851 - RNA, 20 nt, Artificial Sequence
  source: /note="Description of Artificial Sequence: Synthetic oligonucleotide"
cccagcugcuugggagguug

SEQ ID NO: 9852 - RNA, 20 nt, Artificial Sequence
  source: /note="Description of Artificial Sequence: Synthetic oligonucleotide"
ccugagaaucgcuugaaucc

SEQ ID NO: 9853 - RNA, 20 nt, Artificial Sequence
  source: /note="Description of Artificial Sequence: Synthetic oligonucleotide"
gagaaucgcuugaauccagg

SEQ ID NO: 9854 - RNA, 20 nt, Artificial Sequence
  source: /note="Description of Artificial Sequence: Synthetic oligonucleotide"
cgcuugaauccaggaggcag

SEQ ID NO: 9855 - RNA, 20 nt, Artificial Sequence
  source: /note="Description of Artificial Sequence: Synthetic oligonucleotide"
cgugccacugcacuccagcc

SEQ ID NO: 9856 - RNA, 20 nt, Artificial Sequence
  source: /note="Description of Artificial Sequence: Synthetic oligonucleotide"
gugccacugcacuccagccu

SEQ ID NO: 9857 - RNA, 20 nt, Artificial Sequence
  source: /note="Description of Artificial Sequence: Synthetic oligonucleotide"
cuccagccugggugacagag

SEQ ID NO: 9858 - RNA, 20 nt, Artificial Sequence
  source: /note="Description of Artificial Sequence: Synthetic oligonucleotide"
uccagccugggugacagagu

SEQ ID NO: 9859 - RNA, 20 nt, Artificial Sequence
  source: /note="Description of Artificial Sequence: Synthetic oligonucleotide"
uacacaccauuauacacaag

SEQ ID NO: 9860 - RNA, 20 nt, Artificial Sequence
  source: /note="Description of Artificial Sequence: Synthetic oligonucleotide"
uagacccaacauauauaaua

SEQ ID NO: 9861 - RNA, 20 nt, Artificial Sequence
  source: /note="Description of Artificial Sequence: Synthetic oligonucleotide"
uuuaacaaagaugauucaau

SEQ ID NO: 9862 - RNA, 20 nt, Artificial Sequence
  source: /note="Description of Artificial Sequence: Synthetic oligonucleotide"
uuaacaaagaugauucaauu

SEQ ID NO: 9863 - RNA, 20 nt, Artificial Sequence
  source: /note="Description of Artificial Sequence: Synthetic oligonucleotide"
caaagaugauucaauuggga

SEQ ID NO: 9864 - RNA, 20 nt, Artificial Sequence
  source: /note="Description of Artificial Sequence: Synthetic oligonucleotide"
aaagaugauucaauugggaa

SEQ ID NO: 9865 - RNA, 20 nt, Artificial Sequence
  source: /note="Description of Artificial Sequence: Synthetic oligonucleotide"
uccaguaguaucugaacagu

SEQ ID NO: 9866 - RNA, 20 nt, Artificial Sequence
  source: /note="Description of Artificial Sequence: Synthetic oligonucleotide"
ugaacaguuggaaagccaua

SEQ ID NO: 9867 - RNA, 20 nt, Artificial Sequence
  source: /note="Description of Artificial Sequence: Synthetic oligonucleotide"
gaacaguuggaaagccauaa

SEQ ID NO: 9868 - RNA, 20 nt, Artificial Sequence
  source: /note="Description of Artificial Sequence: Synthetic oligonucleotide"
ggaaagccauaagggaaaaa

SEQ ID NO: 9869 - RNA, 20 nt, Artificial Sequence
  source: /note="Description of Artificial Sequence: Synthetic oligonucleotide"
uaguugucugagaacaaagc

SEQ ID NO: 9870 - RNA, 20 nt, Artificial Sequence
  source: /note="Description of Artificial Sequence: Synthetic oligonucleotide"
gcaggaagcaugaauuauac

SEQ ID NO: 9871 - RNA, 20 nt, Artificial Sequence
  source: /note="Description of Artificial Sequence: Synthetic oligonucleotide"
caggaagcaugaauuauaca

SEQ ID NO: 9872 - RNA, 20 nt, Artificial Sequence
  source: /note="Description of Artificial Sequence: Synthetic oligonucleotide"
aggaagcaugaauuauacag

SEQ ID NO: 9873 - RNA, 20 nt, Artificial Sequence
  source: /note="Description of Artificial Sequence: Synthetic oligonucleotide"
augaauuauacaggggcaug

SEQ ID NO: 9874 - RNA, 20 nt, Artificial Sequence
  source: /note="Description of Artificial Sequence: Synthetic oligonucleotide"
aaugaauauguacuuuauuu

SEQ ID NO: 9875 - RNA, 20 nt, Artificial Sequence
  source: /note="Description of Artificial Sequence: Synthetic oligonucleotide"
aacucaaauagcauacuuua

SEQ ID NO: 9876 - RNA, 20 nt, Artificial Sequence
  source: /note="Description of Artificial Sequence: Synthetic oligonucleotide"
gugucauuccauuuuguuuc

SEQ ID NO: 9877 - RNA, 20 nt, Artificial Sequence
  source: /note="Description of Artificial Sequence: Synthetic oligonucleotide"
cauuuuuuuaaaguucuaaa

SEQ ID NO: 9878 - RNA, 20 nt, Artificial Sequence
  source: /note="Description of Artificial Sequence: Synthetic oligonucleotide"
ucuaaauacuagugaguuuu

SEQ ID NO: 9879 - RNA, 20 nt, Artificial Sequence
  source: /note="Description of Artificial Sequence: Synthetic oligonucleotide"
ucaaaaauauuuuuggacau

SEQ ID NO: 9880 - RNA, 20 nt, Artificial Sequence
  source: /note="Description of Artificial Sequence: Synthetic oligonucleotide"
cauuguuucaaaaauauuuu

SEQ ID NO: 9881 - RNA, 20 nt, Artificial Sequence
  source: /note="Description of Artificial Sequence: Synthetic oligonucleotide"
cagugguuucaacaauuaag

SEQ ID NO: 9882 - RNA, 20 nt, Artificial Sequence
  source: /note="Description of Artificial Sequence: Synthetic oligonucleotide"
cucgaaacugaacacugcag

SEQ ID NO: 9883 - RNA, 20 nt, Artificial Sequence
  source: /note="Description of Artificial Sequence: Synthetic oligonucleotide"
aaaaaaaauguacuuuugua

SEQ ID NO: 9884 - RNA, 20 nt, Artificial Sequence
  source: /note="Description of Artificial Sequence: Synthetic oligonucleotide"
guaguuagaaccuauagcuu

SEQ ID NO: 9885 - RNA, 20 nt, Artificial Sequence
  source: /note="Description of Artificial Sequence: Synthetic oligonucleotide"
gguaguuagaaccuauagcu

SEQ ID NO: 9886 - RNA, 20 nt, Artificial Sequence
  source: /note="Description of Artificial Sequence: Synthetic oligonucleotide"
uauagacuugcaguaaaaau

SEQ ID NO: 9887 - RNA, 20 nt, Artificial Sequence
  source: /note="Description of Artificial Sequence: Synthetic oligonucleotide"
ucagcaaaaucugacacauc

SEQ ID NO: 9888 - RNA, 20 nt, Artificial Sequence
  source: /note="Description of Artificial Sequence: Synthetic oligonucleotide"
aagucaaggucaaacaaaaa

SEQ ID NO: 9889 - RNA, 20 nt, Artificial Sequence
  source: /note="Description of Artificial Sequence: Synthetic oligonucleotide"
uugcuugguguaugaaguca

SEQ ID NO: 9890 - RNA, 20 nt, Artificial Sequence
  source: /note="Description of Artificial Sequence: Synthetic oligonucleotide"
aaaaaaaaaauguuuuugcu

SEQ ID NO: 9891 - RNA, 20 nt, Artificial Sequence
  source: /note="Description of Artificial Sequence: Synthetic oligonucleotide"
uucuuaaagacagacagaga

SEQ ID NO: 9892 - RNA, 20 nt, Artificial Sequence
  source: /note="Description of Artificial Sequence: Synthetic oligonucleotide"
cgguggcaugggucgaaaga

SEQ ID NO: 9893 - RNA, 20 nt, Artificial Sequence
  source: /note="Description of Artificial Sequence: Synthetic oligonucleotide"
aggguuucacaacccuaauu

SEQ ID NO: 9894 - RNA, 20 nt, Artificial Sequence
  source: /note="Description of Artificial Sequence: Synthetic oligonucleotide"
ggaaccggaggguuucacaa

SEQ ID NO: 9895 - RNA, 20 nt, Artificial Sequence
  source: /note="Description of Artificial Sequence: Synthetic oligonucleotide"
cggaaccggaggguuucaca

SEQ ID NO: 9896 - RNA, 20 nt, Artificial Sequence
  source: /note="Description of Artificial Sequence: Synthetic oligonucleotide"
gaguccacuagguggacgga

SEQ ID NO: 9897 - RNA, 20 nt, Artificial Sequence
  source: /note="Description of Artificial Sequence: Synthetic oligonucleotide"
ccagaucuugaggacuggag

SEQ ID NO: 9898 - RNA, 20 nt, Artificial Sequence
  source: /note="Description of Artificial Sequence: Synthetic oligonucleotide"
aaagagguacaacuaguccg

SEQ ID NO: 9899 - RNA, 20 nt, Artificial Sequence
  source: /note="Description of Artificial Sequence: Synthetic oligonucleotide"
ucccaaagagguacaacuag

SEQ ID NO: 9900 - RNA, 20 nt, Artificial Sequence
  source: /note="Description of Artificial Sequence: Synthetic oligonucleotide"
aacauaaaaaucaucucugu

SEQ ID NO: 9901 - RNA, 20 nt, Artificial Sequence
  source: /note="Description of Artificial Sequence: Synthetic oligonucleotide"
aaacauaaaaaucaucucug

SEQ ID NO: 9902 - RNA, 20 nt, Artificial Sequence
  source: /note="Description of Artificial Sequence: Synthetic oligonucleotide"
aaggcucaucgacccuaaug

SEQ ID NO: 9903 - RNA, 20 nt, Artificial Sequence
  source: /note="Description of Artificial Sequence: Synthetic oligonucleotide"
ggaaucggaaggcucaucga

SEQ ID NO: 9904 - RNA, 20 nt, Artificial Sequence
  source: /note="Description of Artificial Sequence: Synthetic oligonucleotide"
cggaaucggaaggcucaucg

SEQ ID NO: 9905 - RNA, 20 nt, Artificial Sequence
  source: /note="Description of Artificial Sequence: Synthetic oligonucleotide"
gugacguuggagguggaggg

SEQ ID NO: 9906 - RNA, 20 nt, Artificial Sequence
  source: /note="Description of Artificial Sequence: Synthetic oligonucleotide"
ccucacguuaccaaacugaa

SEQ ID NO: 9907 - RNA, 20 nt, Artificial Sequence
  source: /note="Description of Artificial Sequence: Synthetic oligonucleotide"
aacggauccgaccucacguu

SEQ ID NO: 9908 - RNA, 20 nt, Artificial Sequence
  source: /note="Description of Artificial Sequence: Synthetic oligonucleotide"
aagcgagaacaacggauccg

SEQ ID NO: 9909 - RNA, 20 nt, Artificial Sequence
  source: /note="Description of Artificial Sequence: Synthetic oligonucleotide"
cucaaagcgagaacaacgga

SEQ ID NO: 9910 - RNA, 20 nt, Artificial Sequence
  source: /note="Description of Artificial Sequence: Synthetic oligonucleotide"
aaaaaaaaaaaaaaaacucu

SEQ ID NO: 9911 - RNA, 20 nt, Artificial Sequence
  source: /note="Description of Artificial Sequence: Synthetic oligonucleotide"
aggacccaucgacccuaaug

SEQ ID NO: 9912 - RNA, 20 nt, Artificial Sequence
  source: /note="Description of Artificial Sequence: Synthetic oligonucleotide"
aggaccagaggacccaucga

SEQ ID NO: 9913 - RNA, 20 nt, Artificial Sequence
  source: /note="Description of Artificial Sequence: Synthetic oligonucleotide"
gaggaccagaggacccaucg

SEQ ID NO: 9914 - RNA, 20 nt, Artificial Sequence
  source: /note="Description of Artificial Sequence: Synthetic oligonucleotide"
ggagucugaggaccagagga

SEQ ID NO: 9915 - RNA, 20 nt, Artificial Sequence
  source: /note="Description of Artificial Sequence: Synthetic oligonucleotide"
cggagucugaggaccagagg

SEQ ID NO: 9916 - RNA, 20 nt, Artificial Sequence
  source: /note="Description of Artificial Sequence: Synthetic oligonucleotide"
aguggcgucggagucugagg

SEQ ID NO: 9917 - RNA, 20 nt, Artificial Sequence
  source: /note="Description of Artificial Sequence: Synthetic oligonucleotide"
ccucgugucacuacguuagu

SEQ ID NO: 9918 - RNA, 20 nt, Artificial Sequence
  source: /note="Description of Artificial Sequence: Synthetic oligonucleotide"
caguagaaacaguggguccu

SEQ ID NO: 9919 - RNA, 20 nt, Artificial Sequence
  source: /note="Description of Artificial Sequence: Synthetic oligonucleotide"
gacccaguagaaacaguggg

SEQ ID NO: 9920 - RNA, 20 nt, Artificial Sequence
  source: /note="Description of Artificial Sequence: Synthetic oligonucleotide"
aacgaaaaaaaaaucuuaga

SEQ ID NO: 9921 - RNA, 20 nt, Artificial Sequence
  source: /note="Description of Artificial Sequence: Synthetic oligonucleotide"
aaacgaaaaaaaaaucuuag

SEQ ID NO: 9922 - RNA, 20 nt, Artificial Sequence
  source: /note="Description of Artificial Sequence: Synthetic oligonucleotide"
gucucugucuccacuaaaga

SEQ ID NO: 9923 - RNA, 20 nt, Artificial Sequence
  source: /note="Description of Artificial Sequence: Synthetic oligonucleotide"
gcacauucuucuauuccagc

SEQ ID NO: 9924 - RNA, 20 nt, Artificial Sequence
  source: /note="Description of Artificial Sequence: Synthetic oligonucleotide"
gugacaucuagucuacuuuu

SEQ ID NO: 9925 - RNA, 20 nt, Artificial Sequence
  source: /note="Description of Artificial Sequence: Synthetic oligonucleotide"
ugugacaucuagucuacuuu

SEQ ID NO: 9926 - RNA, 20 nt, Artificial Sequence
  source: /note="Description of Artificial Sequence: Synthetic oligonucleotide"
agaucuuuauuuagcgucua

SEQ ID NO: 9927 - RNA, 20 nt, Artificial Sequence
  source: /note="Description of Artificial Sequence: Synthetic oligonucleotide"
acacacuugaaacagcccaa

SEQ ID NO: 9928 - RNA, 20 nt, Artificial Sequence
  source: /note="Description of Artificial Sequence: Synthetic oligonucleotide"
uaaguuauauuucccuuacu

SEQ ID NO: 9929 - RNA, 20 nt, Artificial Sequence
  source: /note="Description of Artificial Sequence: Synthetic oligonucleotide"
uuaauuccugccauuucuuu

SEQ ID NO: 9930 - RNA, 20 nt, Artificial Sequence
  source: /note="Description of Artificial Sequence: Synthetic oligonucleotide"
auagaacuaccuguccaaac

SEQ ID NO: 9931 - RNA, 20 nt, Artificial Sequence
  source: /note="Description of Artificial Sequence: Synthetic oligonucleotide"
cucaugccuaaaaugauuga

SEQ ID NO: 9932 - RNA, 20 nt, Artificial Sequence
  source: /note="Description of Artificial Sequence: Synthetic oligonucleotide"
ucccccaguucuuacuucau

SEQ ID NO: 9933 - RNA, 20 nt, Artificial Sequence
  source: /note="Description of Artificial Sequence: Synthetic oligonucleotide"
gcuccuguauacucugcucu

SEQ ID NO: 9934 - RNA, 20 nt, Artificial Sequence
  source: /note="Description of Artificial Sequence: Synthetic oligonucleotide"
ugcuccuguauacucugcuc

SEQ ID NO: 9935 - RNA, 20 nt, Artificial Sequence
  source: /note="Description of Artificial Sequence: Synthetic oligonucleotide"
aagaguagcuaaaucauuuu

SEQ ID NO: 9936 - RNA, 20 nt, Artificial Sequence
  source: /note="Description of Artificial Sequence: Synthetic oligonucleotide"
ugggacguuaaaguccacag

SEQ ID NO: 9937 - RNA, 20 nt, Artificial Sequence
  source: /note="Description of Artificial Sequence: Synthetic oligonucleotide"
aaaaaaaaaaaaaaauguuu

SEQ ID NO: 9938 - RNA, 20 nt, Artificial Sequence
  source: /note="Description of Artificial Sequence: Synthetic oligonucleotide"
caaaaaaaaaaaaaaauguu

SEQ ID NO: 9939 - RNA, 20 nt, Artificial Sequence
  source: /note="Description of Artificial Sequence: Synthetic oligonucleotide"
cgguccauaauaagaaucaa

SEQ ID NO: 9940 - RNA, 20 nt, Artificial Sequence
  source: /note="Description of Artificial Sequence: Synthetic oligonucleotide"
acgguccauaauaagaauca

SEQ ID NO: 9941 - RNA, 20 nt, Artificial Sequence
  source: /note="Description of Artificial Sequence: Synthetic oligonucleotide"
aaauaguuucaaguaugaga

SEQ ID NO: 9942 - RNA, 20 nt, Artificial Sequence
  source: /note="Description of Artificial Sequence: Synthetic oligonucleotide"
auuuuggguacuuaaguuuu

SEQ ID NO: 9943 - RNA, 20 nt, Artificial Sequence
  source: /note="Description of Artificial Sequence: Synthetic oligonucleotide"
auuugauggcuucauauuuu

SEQ ID NO: 9944 - RNA, 20 nt, Artificial Sequence
  source: /note="Description of Artificial Sequence: Synthetic oligonucleotide"
uauuugauggcuucauauuu

SEQ ID NO: 9945 - RNA, 20 nt, Artificial Sequence
  source: /note="Description of Artificial Sequence: Synthetic oligonucleotide"
uaaaacuugaacauauuuga

SEQ ID NO: 9946 - RNA, 20 nt, Artificial Sequence
  source: /note="Description of Artificial Sequence: Synthetic oligonucleotide"
gauuucguauaauuguaugu

SEQ ID NO: 9947 - RNA, 20 nt, Artificial Sequence
  source: /note="Description of Artificial Sequence: Synthetic oligonucleotide"
augacacaccuuuguagugu

SEQ ID NO: 9948 - RNA, 20 nt, Artificial Sequence
  source: /note="Description of Artificial Sequence: Synthetic oligonucleotide"
accagaagggcacaugacac

SEQ ID NO: 9949 - RNA, 20 nt, Artificial Sequence
  source: /note="Description of Artificial Sequence: Synthetic oligonucleotide"
ugucguagauauuguaguuu

SEQ ID NO: 9950 - RNA, 20 nt, Artificial Sequence
  source: /note="Description of Artificial Sequence: Synthetic oligonucleotide"
ccuccauuucuaguuuauca

SEQ ID NO: 9951 - RNA, 20 nt, Artificial Sequence
  source: /note="Description of Artificial Sequence: Synthetic oligonucleotide"
gacacucaguuggggaaucc

SEQ ID NO: 9952 - RNA, 20 nt, Artificial Sequence
  source: /note="Description of Artificial Sequence: Synthetic oligonucleotide"
uacgacacucaguuggggaa

SEQ ID NO: 9953 - RNA, 20 nt, Artificial Sequence
  source: /note="Description of Artificial Sequence: Synthetic oligonucleotide"
agagauacgacacucaguug

SEQ ID NO: 9954 - RNA, 20 nt, Artificial Sequence
  source: /note="Description of Artificial Sequence: Synthetic oligonucleotide"
uagagauacgacacucaguu

SEQ ID NO: 9955 - RNA, 20 nt, Artificial Sequence
  source: /note="Description of Artificial Sequence: Synthetic oligonucleotide"
auagagauacgacacucagu

SEQ ID NO: 9956 - RNA, 20 nt, Artificial Sequence
  source: /note="Description of Artificial Sequence: Synthetic oligonucleotide"
ugaaaucaaggaauaaagca

SEQ ID NO: 9957 - RNA, 20 nt, Artificial Sequence
  source: /note="Description of Artificial Sequence: Synthetic oligonucleotide"
aauaagacuucaugaaauca

SEQ ID NO: 9958 - RNA, 20 nt, Artificial Sequence
  source: /note="Description of Artificial Sequence: Synthetic oligonucleotide"
gacugacagaagagaugcug

SEQ ID NO: 9959 - RNA, 20 nt, Artificial Sequence
  source: /note="Description of Artificial Sequence: Synthetic oligonucleotide"
aacugaagcucuaauuccau

SEQ ID NO: 9960 - RNA, 20 nt, Artificial Sequence
  source: /note="Description of Artificial Sequence: Synthetic oligonucleotide"
aaacugaagcucuaauucca

SEQ ID NO: 9961 - RNA, 20 nt, Artificial Sequence
  source: /note="Description of Artificial Sequence: Synthetic oligonucleotide"
uacuggauagacacgaagaa

SEQ ID NO: 9962 - RNA, 20 nt, Artificial Sequence
  source: /note="Description of Artificial Sequence: Synthetic oligonucleotide"
agagccaaauauaugucuac

SEQ ID NO: 9963 - RNA, 20 nt, Artificial Sequence
  source: /note="Description of Artificial Sequence: Synthetic oligonucleotide"
cuacuguuaaauuguaaggc

SEQ ID NO: 9964 - RNA, 20 nt, Artificial Sequence
  source: /note="Description of Artificial Sequence: Synthetic oligonucleotide"
aggucuacuguuaaauugua

SEQ ID NO: 9965 - RNA, 20 nt, Artificial Sequence
  source: /note="Description of Artificial Sequence: Synthetic oligonucleotide"
agauugacaccugcuauuuc

SEQ ID NO: 9966 - RNA, 20 nt, Artificial Sequence
  source: /note="Description of Artificial Sequence: Synthetic oligonucleotide"
acaauuuauuauugguguac

SEQ ID NO: 9967 - RNA, 20 nt, Artificial Sequence
  source: /note="Description of Artificial Sequence: Synthetic oligonucleotide"
accauugguaauagguguac

SEQ ID NO: 9968 - RNA, 20 nt, Artificial Sequence
  source: /note="Description of Artificial Sequence: Synthetic oligonucleotide"
auuccaacacgacaagugau

SEQ ID NO: 9969 - RNA, 20 nt, Artificial Sequence
  source: /note="Description of Artificial Sequence: Synthetic oligonucleotide"
guauugaaagacuaccagau

SEQ ID NO: 9970 - RNA, 20 nt, Artificial Sequence
  source: /note="Description of Artificial Sequence: Synthetic oligonucleotide"
gauuuacguauugaaagacu

SEQ ID NO: 9971 - RNA, 20 nt, Artificial Sequence
  source: /note="Description of Artificial Sequence: Synthetic oligonucleotide"
accuuuagguagauuuacag

SEQ ID NO: 9972 - RNA, 20 nt, Artificial Sequence
  source: /note="Description of Artificial Sequence: Synthetic oligonucleotide"
ccuaaaacacuuacuuaaug

SEQ ID NO: 9973 - RNA, 20 nt, Artificial Sequence
  source: /note="Description of Artificial Sequence: Synthetic oligonucleotide"
agaggauuuuuuaugguacg

SEQ ID NO: 9974 - RNA, 20 nt, Artificial Sequence
  source: /note="Description of Artificial Sequence: Synthetic oligonucleotide"
uggcccaagucaaguacgac

SEQ ID NO: 9975 - RNA, 20 nt, Artificial Sequence
  source: /note="Description of Artificial Sequence: Synthetic oligonucleotide"
uaacauagaugugugcuuug

SEQ ID NO: 9976 - RNA, 20 nt, Artificial Sequence
  source: /note="Description of Artificial Sequence: Synthetic oligonucleotide"
cuuuggccaaaggaaaauga

SEQ ID NO: 9977 - RNA, 20 nt, Artificial Sequence
  source: /note="Description of Artificial Sequence: Synthetic oligonucleotide"
ccucauaaaacuuuggccaa

SEQ ID NO: 9978 - RNA, 20 nt, Artificial Sequence
  source: /note="Description of Artificial Sequence: Synthetic oligonucleotide"
uaucuaaccucauaaaacuu

SEQ ID NO: 9979 - RNA, 20 nt, Artificial Sequence
  source: /note="Description of Artificial Sequence: Synthetic oligonucleotide"
ggcuucauauuauuuacugu

SEQ ID NO: 9980 - RNA, 20 nt, Artificial Sequence
  source: /note="Description of Artificial Sequence: Synthetic oligonucleotide"
auuaggauaaaaguuugugg

SEQ ID NO: 9981 - RNA, 20 nt, Artificial Sequence
  source: /note="Description of Artificial Sequence: Synthetic oligonucleotide"
ugcauuaggauaaaaguuug

SEQ ID NO: 9982 - RNA, 20 nt, Artificial Sequence
  source: /note="Description of Artificial Sequence: Synthetic oligonucleotide"
gaucuucaugaacuugcauu

SEQ ID NO: 9983 - RNA, 20 nt, Artificial Sequence
  source: /note="Description of Artificial Sequence: Synthetic oligonucleotide"
ucagagacaaaugagguagu

SEQ ID NO: 9984 - RNA, 20 nt, Artificial Sequence
  source: /note="Description of Artificial Sequence: Synthetic oligonucleotide"
caaaaaagaauuuacacauu

SEQ ID NO: 9985 - RNA, 20 nt, Artificial Sequence
  source: /note="Description of Artificial Sequence: Synthetic oligonucleotide"
gaaaaaugaaggaaagagag

SEQ ID NO: 9986 - RNA, 20 nt, Artificial Sequence
  source: /note="Description of Artificial Sequence: Synthetic oligonucleotide"
uucauuugaccccauaaaua

SEQ ID NO: 9987 - RNA, 20 nt, Artificial Sequence
  source: /note="Description of Artificial Sequence: Synthetic oligonucleotide"
agagaaguccuucauuugac

SEQ ID NO: 9988 - RNA, 20 nt, Artificial Sequence
  source: /note="Description of Artificial Sequence: Synthetic oligonucleotide"
gagagaaguccuucauuuga

SEQ ID NO: 9989 - RNA, 20 nt, Artificial Sequence
  source: /note="Description of Artificial Sequence: Synthetic oligonucleotide"
ugagagaaguccuucauuug

SEQ ID NO: 9990 - RNA, 20 nt, Artificial Sequence
  source: /note="Description of Artificial Sequence: Synthetic oligonucleotide"
accucggauuaugagagaag

SEQ ID NO: 9991 - RNA, 20 nt, Artificial Sequence
  source: /note="Description of Artificial Sequence: Synthetic oligonucleotide"
acccaaggaugaccgaugug

SEQ ID NO: 9992 - RNA, 20 nt, Artificial Sequence
  source: /note="Description of Artificial Sequence: Synthetic oligonucleotide"
cccacacaaacccaaggaug

SEQ ID NO: 9993 - RNA, 20 nt, Artificial Sequence
  source: /note="Description of Artificial Sequence: Synthetic oligonucleotide"
ucuauuccgacccacacaaa

SEQ ID NO: 9994 - RNA, 20 nt, Artificial Sequence
  source: /note="Description of Artificial Sequence: Synthetic oligonucleotide"
cucuauuccgacccacacaa

SEQ ID NO: 9995 - RNA, 20 nt, Artificial Sequence
  source: /note="Description of Artificial Sequence: Synthetic oligonucleotide"
gaauuaugucucuauuccga

SEQ ID NO: 9996 - RNA, 20 nt, Artificial Sequence
  source: /note="Description of Artificial Sequence: Synthetic oligonucleotide"
ggaauuaugucucuauuccg

SEQ ID NO: 9997 - RNA, 20 nt, Artificial Sequence
  source: /note="Description of Artificial Sequence: Synthetic oligonucleotide"
cagaggaauuaugucucuau

SEQ ID NO: 9998 - RNA, 20 nt, Artificial Sequence
  source: /note="Description of Artificial Sequence: Synthetic oligonucleotide"
uaucacuugagagcagugga

SEQ ID NO: 9999 - RNA, 20 nt, Artificial Sequence
  source: /note="Description of Artificial Sequence: Synthetic oligonucleotide"
gucuugggagacguccagag

SEQ ID NO: 10000 - RNA, 20 nt, Artificial Sequence
  source: /note="Description of Artificial Sequence: Synthetic oligonucleotide"
ugaccuagucuugggagacg

SEQ ID NO: 10001 - RNA, 20 nt, Artificial Sequence
  source: /note="Description of Artificial Sequence: Synthetic oligonucleotide"
aaauuaugagucgacuucug

SEQ ID NO: 10002 - RNA, 20 nt, Artificial Sequence
  source: /note="Description of Artificial Sequence: Synthetic oligonucleotide"
caagaaagggauggaucgga

SEQ ID NO: 10003 - RNA, 20 nt, Artificial Sequence
  source: /note="Description of Artificial Sequence: Synthetic oligonucleotide"
uaagacggacgaagaagacu

SEQ ID NO: 10004 - RNA, 20 nt, Artificial Sequence
  source: /note="Description of Artificial Sequence: Synthetic oligonucleotide"
guccaggacacacucuaguu

SEQ ID NO: 10005 - RNA, 20 nt, Artificial Sequence
  source: /note="Description of Artificial Sequence: Synthetic oligonucleotide"
gguccaggacacacucuagu

SEQ ID NO: 10006 - RNA, 20 nt, Artificial Sequence
  source: /note="Description of Artificial Sequence: Synthetic oligonucleotide"
cauacuaguucuugauaagg

SEQ ID NO: 10007 - RNA, 20 nt, Artificial Sequence
  source: /note="Description of Artificial Sequence: Synthetic oligonucleotide"
acuucagaagaggcagaccg

SEQ ID NO: 10008 - RNA, 20 nt, Artificial Sequence
  source: /note="Description of Artificial Sequence: Synthetic oligonucleotide"
uaauacuucagaagaggcag

SEQ ID NO: 10009 - RNA, 20 nt, Artificial Sequence
  source: /note="Description of Artificial Sequence: Synthetic oligonucleotide"
guuuaaaugaagaugauggu

SEQ ID NO: 10010 - RNA, 20 nt, Artificial Sequence
  source: /note="Description of Artificial Sequence: Synthetic oligonucleotide"
uaaaauucguaaaaaucuac

SEQ ID NO: 10011 - RNA, 20 nt, Artificial Sequence
  source: /note="Description of Artificial Sequence: Synthetic oligonucleotide"
auuuaaugaaucuuagucaa

SEQ ID NO: 10012 - RNA, 20 nt, Artificial Sequence
  source: /note="Description of Artificial Sequence: Synthetic oligonucleotide"
cugauauuuaaaauggaaca

SEQ ID NO: 10013 - RNA, 20 nt, Artificial Sequence
  source: /note="Description of Artificial Sequence: Synthetic oligonucleotide"
cauacggaacauaaaagacu

SEQ ID NO: 10014 - RNA, 20 nt, Artificial Sequence
  source: /note="Description of Artificial Sequence: Synthetic oligonucleotide"
aagacggacaaggggucauu

SEQ ID NO: 10015 - RNA, 20 nt, Artificial Sequence
  source: /note="Description of Artificial Sequence: Synthetic oligonucleotide"
cauaguguauacagucaaga

SEQ ID NO: 10016 - RNA, 20 nt, Artificial Sequence
  source: /note="Description of Artificial Sequence: Synthetic oligonucleotide"
acauaguguauacagucaag

SEQ ID NO: 10017 - RNA, 20 nt, Artificial Sequence
  source: /note="Description of Artificial Sequence: Synthetic oligonucleotide"
uagugagaguacgaaaggag

SEQ ID NO: 10018 - RNA, 20 nt, Artificial Sequence
  source: /note="Description of Artificial Sequence: Synthetic oligonucleotide"
ugaagaucuuccaguaacau

SEQ ID NO: 10019 - RNA, 20 nt, Artificial Sequence
  source: /note="Description of Artificial Sequence: Synthetic oligonucleotide"
gugaagaucuuccaguaaca

SEQ ID NO: 10020 - RNA, 20 nt, Artificial Sequence
  source: /note="Description of Artificial Sequence: Synthetic oligonucleotide"
uauauaaaaagugaagaucu

SEQ ID NO: 10021 - RNA, 20 nt, Artificial Sequence
  source: /note="Description of Artificial Sequence: Synthetic oligonucleotide"
cacauuguuauaaccgauua

SEQ ID NO: 10022 - RNA, 20 nt, Artificial Sequence
  source: /note="Description of Artificial Sequence: Synthetic oligonucleotide"
uauauaaucacauuguuaua

SEQ ID NO: 10023 - RNA, 20 nt, Artificial Sequence
  source: /note="Description of Artificial Sequence: Synthetic oligonucleotide"
aagacagaggguggaggaag

SEQ ID NO: 10024 - RNA, 20 nt, Artificial Sequence
  source: /note="Description of Artificial Sequence: Synthetic oligonucleotide"
cuuguuuagacuuuuuuuaa

SEQ ID NO: 10025 - RNA, 20 nt, Artificial Sequence
  source: /note="Description of Artificial Sequence: Synthetic oligonucleotide"
cgacucgacgacucuagaca

SEQ ID NO: 10026 - RNA, 20 nt, Artificial Sequence
  source: /note="Description of Artificial Sequence: Synthetic oligonucleotide"
acgacucgacgacucuagac

SEQ ID NO: 10027 - RNA, 20 nt, Artificial Sequence
  source: /note="Description of Artificial Sequence: Synthetic oligonucleotide"
acagaaacaaaaaauuagac

SEQ ID NO: 10028 - RNA, 20 nt, Artificial Sequence
  source: /note="Description of Artificial Sequence: Synthetic oligonucleotide"
uacagaaacaaaaaauuaga

SEQ ID NO: 10029 - RNA, 20 nt, Artificial Sequence
  source: /note="Description of Artificial Sequence: Synthetic oligonucleotide"
auacagaaacaaaaaauuag

SEQ ID NO: 10030 - RNA, 20 nt, Artificial Sequence
  source: /note="Description of Artificial Sequence: Synthetic oligonucleotide"
uaaccaauauauaaagaccc

SEQ ID NO: 10031 - RNA, 20 nt, Artificial Sequence
  source: /note="Description of Artificial Sequence: Synthetic oligonucleotide"
aaguaaccaauauauaaaga

SEQ ID NO: 10032 - RNA, 20 nt, Artificial Sequence
  source: /note="Description of Artificial Sequence: Synthetic oligonucleotide"
aaaguaaccaauauauaaag

SEQ ID NO: 10033 - RNA, 20 nt, Artificial Sequence
  source: /note="Description of Artificial Sequence: Synthetic oligonucleotide"
aaaaacucucaacaaaagua

SEQ ID NO: 10034 - RNA, 20 nt, Artificial Sequence
  source: /note="Description of Artificial Sequence: Synthetic oligonucleotide"
aauuucacgaucaaacaacc

SEQ ID NO: 10035 - RNA, 20 nt, Artificial Sequence
  source: /note="Description of Artificial Sequence: Synthetic oligonucleotide"
aaaaauuucacgaucaaaca

SEQ ID NO: 10036 - RNA, 20 nt, Artificial Sequence
  source: /note="Description of Artificial Sequence: Synthetic oligonucleotide"
uaguacaagaaagaaggacu

SEQ ID NO: 10037 - RNA, 20 nt, Artificial Sequence
  source: /note="Description of Artificial Sequence: Synthetic oligonucleotide"
acaacuagaccuaaagacag

SEQ ID NO: 10038 - RNA, 20 nt, Artificial Sequence
  source: /note="Description of Artificial Sequence: Synthetic oligonucleotide"
aaguaaaguaauacaacuag

SEQ ID NO: 10039 - RNA, 20 nt, Artificial Sequence
  source: /note="Description of Artificial Sequence: Synthetic oligonucleotide"
aaaaaaaaaaaucaccaaau

SEQ ID NO: 10040 - RNA, 20 nt, Artificial Sequence
  source: /note="Description of Artificial Sequence: Synthetic oligonucleotide"
ugaaaaaaaaaaaaaaaauc

SEQ ID NO: 10041 - RNA, 20 nt, Artificial Sequence
  source: /note="Description of Artificial Sequence: Synthetic oligonucleotide"
aaaguaaaaagacagaaaug

SEQ ID NO: 10042 - RNA, 20 nt, Artificial Sequence
  source: /note="Description of Artificial Sequence: Synthetic oligonucleotide"
auauaaaaauuuuuguaaaa

SEQ ID NO: 10043 - RNA, 20 nt, Artificial Sequence
  source: /note="Description of Artificial Sequence: Synthetic oligonucleotide"
aaaaauauaaauagaaaaaa

SEQ ID NO: 10044 - RNA, 20 nt, Artificial Sequence
  source: /note="Description of Artificial Sequence: Synthetic oligonucleotide"
uacaccaacaacuaugucaa

SEQ ID NO: 10045 - RNA, 20 nt, Artificial Sequence
  source: /note="Description of Artificial Sequence: Synthetic oligonucleotide"
uuacaccaacaacuauguca

SEQ ID NO: 10046 - RNA, 20 nt, Artificial Sequence
  source: /note="Description of Artificial Sequence: Synthetic oligonucleotide"
uuuugguaaauguaaauuac

SEQ ID NO: 10047 - RNA, 20 nt, Artificial Sequence
  source: /note="Description of Artificial Sequence: Synthetic oligonucleotide"
uucgagacggaauauuaauc

SEQ ID NO: 10048 - RNA, 20 nt, Artificial Sequence
  source: /note="Description of Artificial Sequence: Synthetic oligonucleotide"
guucgagacggaauauuaau

SEQ ID NO: 10049 - RNA, 20 nt, Artificial Sequence
  source: /note="Description of Artificial Sequence: Synthetic oligonucleotide"
uguucgagacggaauauuaa

SEQ ID NO: 10050 - RNA, 20 nt, Artificial Sequence
  source: /note="Description of Artificial Sequence: Synthetic oligonucleotide"
auauaaauuucaccaaaaga

SEQ ID NO: 10051 - RNA, 20 nt, Artificial Sequence
  source: /note="Description of Artificial Sequence: Synthetic oligonucleotide"
aacauagaaauauaaauuuc

SEQ ID NO: 10052 - RNA, 20 nt, Artificial Sequence
  source: /note="Description of Artificial Sequence: Synthetic oligonucleotide"
cuuacaacuuauaauaguuu

SEQ ID NO: 10053 - RNA, 20 nt, Artificial Sequence
  source: /note="Description of Artificial Sequence: Synthetic oligonucleotide"
aaagguaaauacauaaauua

SEQ ID NO: 10054 - RNA, 20 nt, Artificial Sequence
  source: /note="Description of Artificial Sequence: Synthetic oligonucleotide"
gauucauaucguaaucgaaa

SEQ ID NO: 10055 - RNA, 20 nt, Artificial Sequence
  source: /note="Description of Artificial Sequence: Synthetic oligonucleotide"
acagaacaaggaauagaauc

SEQ ID NO: 10056 - RNA, 20 nt, Artificial Sequence
  source: /note="Description of Artificial Sequence: Synthetic oligonucleotide"
aacagaacaaggaauagaau

SEQ ID NO: 10057 - RNA, 20 nt, Artificial Sequence
  source: /note="Description of Artificial Sequence: Synthetic oligonucleotide"
caacagaacaaggaauagaa

SEQ ID NO: 10058 - RNA, 20 nt, Artificial Sequence
  source: /note="Description of Artificial Sequence: Synthetic oligonucleotide"
aucuucgucaaccaauuuuu

SEQ ID NO: 10059 - RNA, 20 nt, Artificial Sequence
  source: /note="Description of Artificial Sequence: Synthetic oligonucleotide"
acuacaacuuaucuucguca

SEQ ID NO: 10060 - RNA, 20 nt, Artificial Sequence
  source: /note="Description of Artificial Sequence: Synthetic oligonucleotide"
guauauaauuaaaguaaaag

SEQ ID NO: 10061 - RNA, 20 nt, Artificial Sequence
  source: /note="Description of Artificial Sequence: Synthetic oligonucleotide"
uauaaaacuacgauaaaauu

SEQ ID NO: 10062 - RNA, 20 nt, Artificial Sequence
  source: /note="Description of Artificial Sequence: Synthetic oligonucleotide"
acuuguauaacuaaucaaac

SEQ ID NO: 10063 - RNA, 20 nt, Artificial Sequence
  source: /note="Description of Artificial Sequence: Synthetic oligonucleotide"
aacuuguauaacuaaucaaa

SEQ ID NO: 10064 - RNA, 20 nt, Artificial Sequence
  source: /note="Description of Artificial Sequence: Synthetic oligonucleotide"
uaacuuguauaacuaaucaa

SEQ ID NO: 10065 - RNA, 20 nt, Artificial Sequence
  source: /note="Description of Artificial Sequence: Synthetic oligonucleotide"
aagaaaguuuuuuggacgac

SEQ ID NO: 10066 - RNA, 20 nt, Artificial Sequence
  source: /note="Description of Artificial Sequence: Synthetic oligonucleotide"
uaagaaaguuuuuuggacga

SEQ ID NO: 10067 - RNA, 20 nt, Artificial Sequence
  source: /note="Description of Artificial Sequence: Synthetic oligonucleotide"
uuaagaaaguuuuuuggacg

SEQ ID NO: 10068 - RNA, 20 nt, Artificial Sequence
  source: /note="Description of Artificial Sequence: Synthetic oligonucleotide"
uccgcacucggugacgcgga

SEQ ID NO: 10069 - RNA, 20 nt, Artificial Sequence
  source: /note="Description of Artificial Sequence: Synthetic oligonucleotide"
guccgcacucggugacgcgg

SEQ ID NO: 10070 - RNA, 20 nt, Artificial Sequence
  source: /note="Description of Artificial Sequence: Synthetic oligonucleotide"
aggcuuucacgaccuuaaug

SEQ ID NO: 10071 - RNA, 20 nt, Artificial Sequence
  source: /note="Description of Artificial Sequence: Synthetic oligonucleotide"
uggagccggaggcuuucacg

SEQ ID NO: 10072 - RNA, 20 nt, Artificial Sequence
  source: /note="Description of Artificial Sequence: Synthetic oligonucleotide"
gaguucacuaggugggugga

SEQ ID NO: 10073 - RNA, 20 nt, Artificial Sequence
  source: /note="Description of Artificial Sequence: Synthetic oligonucleotide"
guccgaccagaguuuugagg

SEQ ID NO: 10074 - RNA, 20 nt, Artificial Sequence
  source: /note="Description of Artificial Sequence: Synthetic oligonucleotide"
aaaacgguacaaccgguccg

SEQ ID NO: 10075 - RNA, 20 nt, Artificial Sequence
  source: /note="Description of Artificial Sequence: Synthetic oligonucleotide"
ucucaaaacgguacaaccgg

SEQ ID NO: 10076 - RNA, 20 nt, Artificial Sequence
  source: /note="Description of Artificial Sequence: Synthetic oligonucleotide"
cucuaucucaaaacgguaca

SEQ ID NO: 10077 - RNA, 20 nt, Artificial Sequence
  source: /note="Description of Artificial Sequence: Synthetic oligonucleotide"
ggaguuggaggguucgucga

SEQ ID NO: 10078 - RNA, 20 nt, Artificial Sequence
  source: /note="Description of Artificial Sequence: Synthetic oligonucleotide"
cggaguuggaggguucgucg

SEQ ID NO: 10079 - RNA, 20 nt, Artificial Sequence
  source: /note="Description of Artificial Sequence: Synthetic oligonucleotide"
ggaccuaaguucgcuaagag

SEQ ID NO: 10080 - RNA, 20 nt, Artificial Sequence
  source: /note="Description of Artificial Sequence: Synthetic oligonucleotide"
agugacguuggagacggagg

SEQ ID NO: 10081 - RNA, 20 nt, Artificial Sequence
  source: /note="Description of Artificial Sequence: Synthetic oligonucleotide"
ccucacgucaccgugcuaga

SEQ ID NO: 10082 - RNA, 20 nt, Artificial Sequence
  source: /note="Description of Artificial Sequence: Synthetic oligonucleotide"
accucacgucaccgugcuag

SEQ ID NO: 10083 - RNA, 20 nt, Artificial Sequence
  source: /note="Description of Artificial Sequence: Synthetic oligonucleotide"
aguggguccgaccucacguc

SEQ ID NO: 10084 - RNA, 20 nt, Artificial Sequence
  source: /note="Description of Artificial Sequence: Synthetic oligonucleotide"
agggugagacaguggguccg

SEQ ID NO: 10085 - RNA, 20 nt, Artificial Sequence
  source: /note="Description of Artificial Sequence: Synthetic oligonucleotide"
ucucagggugagacaguggg

SEQ ID NO: 10086 - RNA, 20 nt, Artificial Sequence
  source: /note="Description of Artificial Sequence: Synthetic oligonucleotide"
cacauauuaccacacauaca

SEQ ID NO: 10087 - RNA, 20 nt, Artificial Sequence
  source: /note="Description of Artificial Sequence: Synthetic oligonucleotide"
agacuaggugaacacauauu

SEQ ID NO: 10088 - RNA, 20 nt, Artificial Sequence
  source: /note="Description of Artificial Sequence: Synthetic oligonucleotide"
uauauacaacccagaugaau

SEQ ID NO: 10089 - RNA, 20 nt, Artificial Sequence
  source: /note="Description of Artificial Sequence: Synthetic oligonucleotide"
aacugguauaauauauacaa

SEQ ID NO: 10090 - RNA, 20 nt, Artificial Sequence
  source: /note="Description of Artificial Sequence: Synthetic oligonucleotide"
uaacugguauaauauauaca

SEQ ID NO: 10091 - RNA, 20 nt, Artificial Sequence
  source: /note="Description of Artificial Sequence: Synthetic oligonucleotide"
agucuaugaugaccuauuuu

SEQ ID NO: 10092 - RNA, 20 nt, Artificial Sequence
  source: /note="Description of Artificial Sequence: Synthetic oligonucleotide"
agguugacaagucuaugaug

SEQ ID NO: 10093 - RNA, 20 nt, Artificial Sequence
  source: /note="Description of Artificial Sequence: Synthetic oligonucleotide"
ucuaauggaaaaaagggaau

SEQ ID NO: 10094 - RNA, 20 nt, Artificial Sequence
  source: /note="Description of Artificial Sequence: Synthetic oligonucleotide"
auauuuaccacacuuuaauu

SEQ ID NO: 10095 - RNA, 20 nt, Artificial Sequence
  source: /note="Description of Artificial Sequence: Synthetic oligonucleotide"
aauauuuaccacacuuuaau

SEQ ID NO: 10096 - RNA, 20 nt, Artificial Sequence
  source: /note="Description of Artificial Sequence: Synthetic oligonucleotide"
aaccucaauuaaaaauauuu

SEQ ID NO: 10097 - RNA, 20 nt, Artificial Sequence
  source: /note="Description of Artificial Sequence: Synthetic oligonucleotide"
aaguauauuuaccuaaauaa

SEQ ID NO: 10098 - RNA, 20 nt, Artificial Sequence
  source: /note="Description of Artificial Sequence: Synthetic oligonucleotide"
aaagaucuuaaaguauauuu

SEQ ID NO: 10099 - RNA, 20 nt, Artificial Sequence
  source: /note="Description of Artificial Sequence: Synthetic oligonucleotide"
uuuauuuuauaguguuauug

SEQ ID NO: 10100 - RNA, 20 nt, Artificial Sequence
  source: /note="Description of Artificial Sequence: Synthetic oligonucleotide"
auagagcaaauaucuugaca

SEQ ID NO: 10101 - RNA, 20 nt, Artificial Sequence
  source: /note="Description of Artificial Sequence: Synthetic oligonucleotide"
auauauauccagaaacaaaa

SEQ ID NO: 10102 - RNA, 20 nt, Artificial Sequence
  source: /note="Description of Artificial Sequence: Synthetic oligonucleotide"
auggcagcacauugguaagu

SEQ ID NO: 10103 - RNA, 20 nt, Artificial Sequence
  source: /note="Description of Artificial Sequence: Synthetic oligonucleotide"
uggcagcacauugguaaguu

SEQ ID NO: 10104 - RNA, 20 nt, Artificial Sequence
  source: /note="Description of Artificial Sequence: Synthetic oligonucleotide"
cacauugguaaguugggcug

SEQ ID NO: 10105 - RNA, 20 nt, Artificial Sequence
  source: /note="Description of Artificial Sequence: Synthetic oligonucleotide"
aauaaagacauaugcaagac

SEQ ID NO: 10106 - RNA, 20 nt, Artificial Sequence
  source: /note="Description of Artificial Sequence: Synthetic oligonucleotide"
auaaagacauaugcaagacu

SEQ ID NO: 10107 - RNA, 20 nt, Artificial Sequence
  source: /note="Description of Artificial Sequence: Synthetic oligonucleotide"
caagacuggguaauuuauaa

SEQ ID NO: 10108 - RNA, 20 nt, Artificial Sequence
  source: /note="Description of Artificial Sequence: Synthetic oligonucleotide"
aauugacucacaguuccaca

SEQ ID NO: 10109 - RNA, 20 nt, Artificial Sequence
  source: /note="Description of Artificial Sequence: Synthetic oligonucleotide"
cucacaguuccacauggcug

SEQ ID NO: 10110 - RNA, 20 nt, Artificial Sequence
  source: /note="Description of Artificial Sequence: Synthetic oligonucleotide"
acaguuccacauggcugugg

SEQ ID NO: 10111 - RNA, 20 nt, Artificial Sequence
  source: /note="Description of Artificial Sequence: Synthetic oligonucleotide"
ggccucacaaucauagcuga

SEQ ID NO: 10112 - RNA, 20 nt, Artificial Sequence
  source: /note="Description of Artificial Sequence: Synthetic oligonucleotide"
aucauagcugaaggcaaaug

SEQ ID NO: 10113 - RNA, 20 nt, Artificial Sequence
  source: /note="Description of Artificial Sequence: Synthetic oligonucleotide"
gagcaaagucacaucuuaca

SEQ ID NO: 10114 - RNA, 20 nt, Artificial Sequence
  source: /note="Description of Artificial Sequence: Synthetic oligonucleotide"
caaagucacaucuuacaugg

SEQ ID NO: 10115 - RNA, 20 nt, Artificial Sequence
  source: /note="Description of Artificial Sequence: Synthetic oligonucleotide"
gucacaucuuacauggcggc

SEQ ID NO: 10116 - RNA, 20 nt, Artificial Sequence
  source: /note="Description of Artificial Sequence: Synthetic oligonucleotide"
gcaggcaagagaacaugugc

SEQ ID NO: 10117 - RNA, 20 nt, Artificial Sequence
  source: /note="Description of Artificial Sequence: Synthetic oligonucleotide"
caggcaagagaacaugugca

SEQ ID NO: 10118 - RNA, 20 nt, Artificial Sequence
  source: /note="Description of Artificial Sequence: Synthetic oligonucleotide"
aggcaagagaacaugugcag

SEQ ID NO: 10119 - RNA, 20 nt, Artificial Sequence
  source: /note="Description of Artificial Sequence: Synthetic oligonucleotide"
uuacucuccugagaacagca

SEQ ID NO: 10120 - RNA, 20 nt, Artificial Sequence
  source: /note="Description of Artificial Sequence: Synthetic oligonucleotide"
uacucuccugagaacagcau

SEQ ID NO: 10121 - RNA, 20 nt, Artificial Sequence
  source: /note="Description of Artificial Sequence: Synthetic oligonucleotide"
augauucaauuaccucccac

SEQ ID NO: 10122 - RNA, 20 nt, Artificial Sequence
  source: /note="Description of Artificial Sequence: Synthetic oligonucleotide"
ugauucaauuaccucccacu

SEQ ID NO: 10123 - RNA, 20 nt, Artificial Sequence
  source: /note="Description of Artificial Sequence: Synthetic oligonucleotide"
uggguccuucccaaaacaca

SEQ ID NO: 10124 - RNA, 20 nt, Artificial Sequence
  source: /note="Description of Artificial Sequence: Synthetic oligonucleotide"
ggguccuucccaaaacacau

SEQ ID NO: 10125 - RNA, 20 nt, Artificial Sequence
  source: /note="Description of Artificial Sequence: Synthetic oligonucleotide"
cccaaaacacaugggaauuu

SEQ ID NO: 10126 - RNA, 20 nt, Artificial Sequence
  source: /note="Description of Artificial Sequence: Synthetic oligonucleotide"
ccaaaacacaugggaauuuu

SEQ ID NO: 10127 - RNA, 20 nt, Artificial Sequence
  source: /note="Description of Artificial Sequence: Synthetic oligonucleotide"
uacaauucaagaugagauuu

SEQ ID NO: 10128 - RNA, 20 nt, Artificial Sequence
  source: /note="Description of Artificial Sequence: Synthetic oligonucleotide"
auucaagaugagauuuaggu

SEQ ID NO: 10129 - RNA, 20 nt, Artificial Sequence
  source: /note="Description of Artificial Sequence: Synthetic oligonucleotide"
uucaagaugagauuuaggua

SEQ ID NO: 10130 - RNA, 20 nt, Artificial Sequence
  source: /note="Description of Artificial Sequence: Synthetic oligonucleotide"
aucagcagcaucucauguug

SEQ ID NO: 10131 - RNA, 20 nt, Artificial Sequence
  source: /note="Description of Artificial Sequence: Synthetic oligonucleotide"
cauguugaggagcagaacac

SEQ ID NO: 10132 - RNA, 20 nt, Artificial Sequence
  source: /note="Description of Artificial Sequence: Synthetic oligonucleotide"
cacuggaauuuaguagcauu

SEQ ID NO: 10133 - RNA, 20 nt, Artificial Sequence
  source: /note="Description of Artificial Sequence: Synthetic oligonucleotide"
uagaguaauauguugucugc

SEQ ID NO: 10134 - RNA, 20 nt, Artificial Sequence
  source: /note="Description of Artificial Sequence: Synthetic oligonucleotide"
auguugucugcagguuucac

SEQ ID NO: 10135 - RNA, 20 nt, Artificial Sequence
  source: /note="Description of Artificial Sequence: Synthetic oligonucleotide"
uguugcaaagugaccugcuu

SEQ ID NO: 10136 - RNA, 20 nt, Artificial Sequence
  source: /note="Description of Artificial Sequence: Synthetic oligonucleotide"
auaacuagcacucucaugau

SEQ ID NO: 10137 - RNA, 20 nt, Artificial Sequence
  source: /note="Description of Artificial Sequence: Synthetic oligonucleotide"
cuagcacucucaugauaggu

SEQ ID NO: 10138 - RNA, 20 nt, Artificial Sequence
  source: /note="Description of Artificial Sequence: Synthetic oligonucleotide"
ugacaagcacaugagaauca

SEQ ID NO: 10139 - RNA, 20 nt, Artificial Sequence
  source: /note="Description of Artificial Sequence: Synthetic oligonucleotide"
augagaaucauggaaauccu

SEQ ID NO: 10140 - RNA, 20 nt, Artificial Sequence
  source: /note="Description of Artificial Sequence: Synthetic oligonucleotide"
gccaguuacaguuaacuucc

SEQ ID NO: 10141 - RNA, 20 nt, Artificial Sequence
  source: /note="Description of Artificial Sequence: Synthetic oligonucleotide"
aaaauucagugccaguuacc

SEQ ID NO: 10142 - RNA, 20 nt, Artificial Sequence
  source: /note="Description of Artificial Sequence: Synthetic oligonucleotide"
caucauugucacaguaacug

SEQ ID NO: 10143 - RNA, 20 nt, Artificial Sequence
  source: /note="Description of Artificial Sequence: Synthetic oligonucleotide"
agccugacuacauauuacag

SEQ ID NO: 10144 - RNA, 20 nt, Artificial Sequence
  source: /note="Description of Artificial Sequence: Synthetic oligonucleotide"
gccugacuacauauuacagu

SEQ ID NO: 10145 - RNA, 20 nt, Artificial Sequence
  source: /note="Description of Artificial Sequence: Synthetic oligonucleotide"
acauauuacaguggguaaaa

SEQ ID NO: 10146 - RNA, 20 nt, Artificial Sequence
  source: /note="Description of Artificial Sequence: Synthetic oligonucleotide"
uuacaguggguaaaauggau

SEQ ID NO: 10147 - RNA, 20 nt, Artificial Sequence
  source: /note="Description of Artificial Sequence: Synthetic oligonucleotide"
aaauggaucggucuuguaau

SEQ ID NO: 10148 - RNA, 20 nt, Artificial Sequence
  source: /note="Description of Artificial Sequence: Synthetic oligonucleotide"
uggaucggucuuguaauugg

SEQ ID NO: 10149 - RNA, 20 nt, Artificial Sequence
  source: /note="Description of Artificial Sequence: Synthetic oligonucleotide"
ggucuuguaauuggaggcag

SEQ ID NO: 10150 - RNA, 20 nt, Artificial Sequence
  source: /note="Description of Artificial Sequence: Synthetic oligonucleotide"
uguaauuggaggcaguggug

SEQ ID NO: 10151 - RNA, 20 nt, Artificial Sequence
  source: /note="Description of Artificial Sequence: Synthetic oligonucleotide"
guaauuggaggcagugguga

SEQ ID NO: 10152 - RNA, 20 nt, Artificial Sequence
  source: /note="Description of Artificial Sequence: Synthetic oligonucleotide"
uaauuggaggcaguggugag

SEQ ID NO: 10153 - RNA, 20 nt, Artificial Sequence
  source: /note="Description of Artificial Sequence: Synthetic oligonucleotide"
uauauguucuauaccaacaa

SEQ ID NO: 10154 - RNA, 20 nt, Artificial Sequence
  source: /note="Description of Artificial Sequence: Synthetic oligonucleotide"
auauguucuauaccaacaaa

SEQ ID NO: 10155 - RNA, 20 nt, Artificial Sequence
  source: /note="Description of Artificial Sequence: Synthetic oligonucleotide"
ucuauaccaacaaaggguuc

SEQ ID NO: 10156 - RNA, 20 nt, Artificial Sequence
  source: /note="Description of Artificial Sequence: Synthetic oligonucleotide"
cuauaccaacaaaggguuca

SEQ ID NO: 10157 - RNA, 20 nt, Artificial Sequence
  source: /note="Description of Artificial Sequence: Synthetic oligonucleotide"
ggguauaauuuugcauguaa

SEQ ID NO: 10158 - RNA, 20 nt, Artificial Sequence
  source: /note="Description of Artificial Sequence: Synthetic oligonucleotide"
gguauaauuuugcauguaaa

SEQ ID NO: 10159 - RNA, 20 nt, Artificial Sequence
  source: /note="Description of Artificial Sequence: Synthetic oligonucleotide"
guauaauuuugcauguaaag

SEQ ID NO: 10160 - RNA, 20 nt, Artificial Sequence
  source: /note="Description of Artificial Sequence: Synthetic oligonucleotide"
aaccuaaugaauuaucaaca

SEQ ID NO: 10161 - RNA, 20 nt, Artificial Sequence
  source: /note="Description of Artificial Sequence: Synthetic oligonucleotide"
ugaauuaucaacauggaugu

SEQ ID NO: 10162 - RNA, 20 nt, Artificial Sequence
  source: /note="Description of Artificial Sequence: Synthetic oligonucleotide"
guagguguaguugaagaaga

SEQ ID NO: 10163 - RNA, 20 nt, Artificial Sequence
  source: /note="Description of Artificial Sequence: Synthetic oligonucleotide"
gaagauggucagugagaaua

SEQ ID NO: 10164 - RNA, 20 nt, Artificial Sequence
  source: /note="Description of Artificial Sequence: Synthetic oligonucleotide"
agaauauggaaacagauauc

SEQ ID NO: 10165 - RNA, 20 nt, Artificial Sequence
  source: /note="Description of Artificial Sequence: Synthetic oligonucleotide"
aggaauuaaagucauauucu

SEQ ID NO: 10166 - RNA, 20 nt, Artificial Sequence
  source: /note="Description of Artificial Sequence: Synthetic oligonucleotide"
ggaauuaaagucauauucua

SEQ ID NO: 10167 - RNA, 20 nt, Artificial Sequence
  source: /note="Description of Artificial Sequence: Synthetic oligonucleotide"
cuagggcagaaaagcauuca

SEQ ID NO: 10168 - RNA, 20 nt, Artificial Sequence
  source: /note="Description of Artificial Sequence: Synthetic oligonucleotide"
gggcagaaaagcauucaugg

SEQ ID NO: 10169 - RNA, 20 nt, Artificial Sequence
  source: /note="Description of Artificial Sequence: Synthetic oligonucleotide"
cugaaguaauuugaagaagc

SEQ ID NO: 10170 - RNA, 20 nt, Artificial Sequence
  source: /note="Description of Artificial Sequence: Synthetic oligonucleotide"
uaauguucuagaucagagau

SEQ ID NO: 10171 - RNA, 20 nt, Artificial Sequence
  source: /note="Description of Artificial Sequence: Synthetic oligonucleotide"
uggaaaacucuucucuauaa

SEQ ID NO: 10172 - RNA, 20 nt, Artificial Sequence
  source: /note="Description of Artificial Sequence: Synthetic oligonucleotide"
ggaaaacucuucucuauaaa

SEQ ID NO: 10173 - RNA, 20 nt, Artificial Sequence
  source: /note="Description of Artificial Sequence: Synthetic oligonucleotide"
cuucucuauaaagggcaaga

SEQ ID NO: 10174 - RNA, 20 nt, Artificial Sequence
  source: /note="Description of Artificial Sequence: Synthetic oligonucleotide"
ggcaagaugguaaauauuuu

SEQ ID NO: 10175 - RNA, 20 nt, Artificial Sequence
  source: /note="Description of Artificial Sequence: Synthetic oligonucleotide"
gcaagaugguaaauauuuua

SEQ ID NO: 10176 - RNA, 20 nt, Artificial Sequence
  source: /note="Description of Artificial Sequence: Synthetic oligonucleotide"
guaaauauuuuagggacugc

SEQ ID NO: 10177 - RNA, 20 nt, Artificial Sequence
  source: /note="Description of Artificial Sequence: Synthetic oligonucleotide"
uuagggacugcaggccacau

SEQ ID NO: 10178 - RNA, 20 nt, Artificial Sequence
  source: /note="Description of Artificial Sequence: Synthetic oligonucleotide"
aggauuucugucacauuguu

SEQ ID NO: 10179 - RNA, 20 nt, Artificial Sequence
  source: /note="Description of Artificial Sequence: Synthetic oligonucleotide"
auuucugucacauuguuugg

SEQ ID NO: 10180 - RNA, 20 nt, Artificial Sequence
  source: /note="Description of Artificial Sequence: Synthetic oligonucleotide"
uuucugucacauuguuuggu

SEQ ID NO: 10181 - RNA, 20 nt, Artificial Sequence
  source: /note="Description of Artificial Sequence: Synthetic oligonucleotide"
uucugucacauuguuuggug

SEQ ID NO: 10182 - RNA, 20 nt, Artificial Sequence
  source: /note="Description of Artificial Sequence: Synthetic oligonucleotide"
aaaaaccauucuuaguuuac

SEQ ID NO: 10183 - RNA, 20 nt, Artificial Sequence
  source: /note="Description of Artificial Sequence: Synthetic oligonucleotide"
ccauacaaacacaagcugug

SEQ ID NO: 10184 - RNA, 20 nt, Artificial Sequence
  source: /note="Description of Artificial Sequence: Synthetic oligonucleotide"
cugugaggcacauuagccgu

SEQ ID NO: 10185 - RNA, 20 nt, Artificial Sequence
  source: /note="Description of Artificial Sequence: Synthetic oligonucleotide"
ggcacauuagccguagguuc

SEQ ID NO: 10186 - RNA, 20 nt, Artificial Sequence
  source: /note="Description of Artificial Sequence: Synthetic oligonucleotide"
gauccagaagaacaaacaca

SEQ ID NO: 10187 - RNA, 20 nt, Artificial Sequence
  source: /note="Description of Artificial Sequence: Synthetic oligonucleotide"
cucagcaccugcucauuauu

SEQ ID NO: 10188 - RNA, 20 nt, Artificial Sequence
  source: /note="Description of Artificial Sequence: Synthetic oligonucleotide"
agcaccugcucauuauuagg

SEQ ID NO: 10189 - RNA, 20 nt, Artificial Sequence
  source: /note="Description of Artificial Sequence: Synthetic oligonucleotide"
cagaaguaguaaaugauaac

SEQ ID NO: 10190 - RNA, 20 nt, Artificial Sequence
  source: /note="Description of Artificial Sequence: Synthetic oligonucleotide"
agaaguaguaaaugauaacu

SEQ ID NO: 10191 - RNA, 20 nt, Artificial Sequence
  source: /note="Description of Artificial Sequence: Synthetic oligonucleotide"
gaaguaguaaaugauaacug

SEQ ID NO: 10192 - RNA, 20 nt, Artificial Sequence
  source: /note="Description of Artificial Sequence: Synthetic oligonucleotide"
auauaaccauguuucauucc

SEQ ID NO: 10193 - RNA, 20 nt, Artificial Sequence
  source: /note="Description of Artificial Sequence: Synthetic oligonucleotide"
aaccauguuucauuccagga

SEQ ID NO: 10194 - RNA, 20 nt, Artificial Sequence
  source: /note="Description of Artificial Sequence: Synthetic oligonucleotide"
cagagaguaagaugaugaga

SEQ ID NO: 10195 - RNA, 20 nt, Artificial Sequence
  source: /note="Description of Artificial Sequence: Synthetic oligonucleotide"
aauuugccucugauagagca

SEQ ID NO: 10196 - RNA, 20 nt, Artificial Sequence
  source: /note="Description of Artificial Sequence: Synthetic oligonucleotide"
auuugccucugauagagcau

SEQ ID NO: 10197 - RNA, 20 nt, Artificial Sequence
  source: /note="Description of Artificial Sequence: Synthetic oligonucleotide"
auggguucugugaaguaaaa

SEQ ID NO: 10198 - RNA, 20 nt, Artificial Sequence
  source: /note="Description of Artificial Sequence: Synthetic oligonucleotide"
uucugugaaguaaaauggaa

SEQ ID NO: 10199 - RNA, 20 nt, Artificial Sequence
  source: /note="Description of Artificial Sequence: Synthetic oligonucleotide"
gcacuagauaagaacugaau

SEQ ID NO: 10200 - RNA, 20 nt, Artificial Sequence
  source: /note="Description of Artificial Sequence: Synthetic oligonucleotide"
cacuagauaagaacugaaua

SEQ ID NO: 10201 - RNA, 20 nt, Artificial Sequence
  source: /note="Description of Artificial Sequence: Synthetic oligonucleotide"
ugaauaggguuaaauaugua

SEQ ID NO: 10202 - RNA, 20 nt, Artificial Sequence
  source: /note="Description of Artificial Sequence: Synthetic oligonucleotide"
gaauaggguuaaauauguau

SEQ ID NO: 10203 - RNA, 20 nt, Artificial Sequence
  source: /note="Description of Artificial Sequence: Synthetic oligonucleotide"
uauguaugggaaaaguaaca

SEQ ID NO: 10204 - RNA, 20 nt, Artificial Sequence
  source: /note="Description of Artificial Sequence: Synthetic oligonucleotide"
acuucugugcagaaagugac

SEQ ID NO: 10205 - RNA, 20 nt, Artificial Sequence
  source: /note="Description of Artificial Sequence: Synthetic oligonucleotide"
uuuaauuaucaaagcaacag

SEQ ID NO: 10206 - RNA, 20 nt, Artificial Sequence
  source: /note="Description of Artificial Sequence: Synthetic oligonucleotide"
uuucagaguacccacuuaua

SEQ ID NO: 10207 - RNA, 20 nt, Artificial Sequence
  source: /note="Description of Artificial Sequence: Synthetic oligonucleotide"
aaugaagaaaagagaaaguu

SEQ ID NO: 10208 - RNA, 20 nt, Artificial Sequence
  source: /note="Description of Artificial Sequence: Synthetic oligonucleotide"
uuagguuugacagaguacaa

SEQ ID NO: 10209 - RNA, 20 nt, Artificial Sequence
  source: /note="Description of Artificial Sequence: Synthetic oligonucleotide"
gguuugacagaguacaaagg

SEQ ID NO: 10210 - RNA, 20 nt, Artificial Sequence
  source: /note="Description of Artificial Sequence: Synthetic oligonucleotide"
uuuuuacuucaguuaucuua

SEQ ID NO: 10211 - RNA, 20 nt, Artificial Sequence
  source: /note="Description of Artificial Sequence: Synthetic oligonucleotide"
uuucuuaaacagagagaguu

SEQ ID NO: 10212 - RNA, 20 nt, Artificial Sequence
  source: /note="Description of Artificial Sequence: Synthetic oligonucleotide"
aacagagagaguuagguguc

SEQ ID NO: 10213 - RNA, 20 nt, Artificial Sequence
  source: /note="Description of Artificial Sequence: Synthetic oligonucleotide"
guguucagaaguaugagaug

SEQ ID NO: 10214 - RNA, 20 nt, Artificial Sequence
  source: /note="Description of Artificial Sequence: Synthetic oligonucleotide"
ugugauacuaccaaaaacag

SEQ ID NO: 10215 - RNA, 20 nt, Artificial Sequence
  source: /note="Description of Artificial Sequence: Synthetic oligonucleotide"
cuuuuagccuguuuuugaag

SEQ ID NO: 10216 - RNA, 20 nt, Artificial Sequence
  source: /note="Description of Artificial Sequence: Synthetic oligonucleotide"
agcaagagagugcuucauuu

SEQ ID NO: 10217 - RNA, 20 nt, Artificial Sequence
  source: /note="Description of Artificial Sequence: Synthetic oligonucleotide"
gcaagagagugcuucauuuu

SEQ ID NO: 10218 - RNA, 20 nt, Artificial Sequence
  source: /note="Description of Artificial Sequence: Synthetic oligonucleotide"
caagagagugcuucauuuug

SEQ ID NO: 10219 - RNA, 20 nt, Artificial Sequence
  source: /note="Description of Artificial Sequence: Synthetic oligonucleotide"
aagagagugcuucauuuugg

SEQ ID NO: 10220 - RNA, 20 nt, Artificial Sequence
  source: /note="Description of Artificial Sequence: Synthetic oligonucleotide"
agaaacauaugugaagaaca

SEQ ID NO: 10221 - RNA, 20 nt, Artificial Sequence
  source: /note="Description of Artificial Sequence: Synthetic oligonucleotide"
gaaacauaugugaagaacaa

SEQ ID NO: 10222 - RNA, 20 nt, Artificial Sequence
  source: /note="Description of Artificial Sequence: Synthetic oligonucleotide"
uuccugauagacucagagaa

SEQ ID NO: 10223 - RNA, 20 nt, Artificial Sequence
  source: /note="Description of Artificial Sequence: Synthetic oligonucleotide"
uccugauagacucagagaaa

SEQ ID NO: 10224 - RNA, 20 nt, Artificial Sequence
  source: /note="Description of Artificial Sequence: Synthetic oligonucleotide"
ugauagacucagagaaaggg

SEQ ID NO: 10225 - RNA, 20 nt, Artificial Sequence
  source: /note="Description of Artificial Sequence: Synthetic oligonucleotide"
gauagacucagagaaagggu

SEQ ID NO: 10226 - RNA, 20 nt, Artificial Sequence
  source: /note="Description of Artificial Sequence: Synthetic oligonucleotide"
agacucagagaaaggguggg

SEQ ID NO: 10227 - RNA, 20 nt, Artificial Sequence
  source: /note="Description of Artificial Sequence: Synthetic oligonucleotide"
gacucagagaaagggugggu

SEQ ID NO: 10228 - RNA, 20 nt, Artificial Sequence
  source: /note="Description of Artificial Sequence: Synthetic oligonucleotide"
uugcuauuuucauuaauaac

SEQ ID NO: 10229 - RNA, 20 nt, Artificial Sequence
  source: /note="Description of Artificial Sequence: Synthetic oligonucleotide"
uauuuucauuaauaacaggu

SEQ ID NO: 10230 - RNA, 20 nt, Artificial Sequence
  source: /note="Description of Artificial Sequence: Synthetic oligonucleotide"
uucauuaauaacagguagga

SEQ ID NO: 10231 - RNA, 20 nt, Artificial Sequence
  source: /note="Description of Artificial Sequence: Synthetic oligonucleotide"
uaacagguaggaugguuuua

SEQ ID NO: 10232 - RNA, 20 nt, Artificial Sequence
  source: /note="Description of Artificial Sequence: Synthetic oligonucleotide"
uaauauauaugucacugauc

SEQ ID NO: 10233 - RNA, 20 nt, Artificial Sequence
  source: /note="Description of Artificial Sequence: Synthetic oligonucleotide"
gucacugaucuggaucaacu

SEQ ID NO: 10234 - RNA, 20 nt, Artificial Sequence
  source: /note="Description of Artificial Sequence: Synthetic oligonucleotide"
acacaaaucugaauacugag

SEQ ID NO: 10235 - RNA, 20 nt, Artificial Sequence
  source: /note="Description of Artificial Sequence: Synthetic oligonucleotide"
acacacacacacguuuucuu

SEQ ID NO: 10236 - RNA, 20 nt, Artificial Sequence
  source: /note="Description of Artificial Sequence: Synthetic oligonucleotide"
cacacacacacguuuucuuu

SEQ ID NO: 10237 - RNA, 20 nt, Artificial Sequence
  source: /note="Description of Artificial Sequence: Synthetic oligonucleotide"
uucuuugggaccuguaguug

SEQ ID NO: 10238 - RNA, 20 nt, Artificial Sequence
  source: /note="Description of Artificial Sequence: Synthetic oligonucleotide"
cacuccggaggugucgguac

SEQ ID NO: 10239 - RNA, 20 nt, Artificial Sequence
  source: /note="Description of Artificial Sequence: Synthetic oligonucleotide"
acggaagucgauacuaacac

SEQ ID NO: 10240 - RNA, 20 nt, Artificial Sequence
  source: /note="Description of Artificial Sequence: Synthetic oligonucleotide"
cuagacuacuaaaauauuuc

SEQ ID NO: 10241 - RNA, 20 nt, Artificial Sequence
  source: /note="Description of Artificial Sequence: Synthetic oligonucleotide"
ucuagacuacuaaaauauuu

SEQ ID NO: 10242 - RNA, 20 nt, Artificial Sequence
  source: /note="Description of Artificial Sequence: Synthetic oligonucleotide"
cucuagacuacuaaaauauu

SEQ ID NO: 10243 - RNA, 20 nt, Artificial Sequence
  source: /note="Description of Artificial Sequence: Synthetic oligonucleotide"
uagaaaggguacgacaagag

SEQ ID NO: 10244 - RNA, 20 nt, Artificial Sequence
  source: /note="Description of Artificial Sequence: Synthetic oligonucleotide"
cccuccauuaacuuaguacc

SEQ ID NO: 10245 - RNA, 20 nt, Artificial Sequence
  source: /note="Description of Artificial Sequence: Synthetic oligonucleotide"
acccuccauuaacuuaguac

SEQ ID NO: 10246 - RNA, 20 nt, Artificial Sequence
  source: /note="Description of Artificial Sequence: Synthetic oligonucleotide"
cacccuccauuaacuuagua

SEQ ID NO: 10247 - RNA, 20 nt, Artificial Sequence
  source: /note="Description of Artificial Sequence: Synthetic oligonucleotide"
ucacccuccauuaacuuagu

SEQ ID NO: 10248 - RNA, 20 nt, Artificial Sequence
  source: /note="Description of Artificial Sequence: Synthetic oligonucleotide"
aaacccuuccugggucaccc

SEQ ID NO: 10249 - RNA, 20 nt, Artificial Sequence
  source: /note="Description of Artificial Sequence: Synthetic oligonucleotide"
acaaaacccuuccuggguca

SEQ ID NO: 10250 - RNA, 20 nt, Artificial Sequence
  source: /note="Description of Artificial Sequence: Synthetic oligonucleotide"
cacaaaacccuuccuggguc

SEQ ID NO: 10251 - RNA, 20 nt, Artificial Sequence
  source: /note="Description of Artificial Sequence: Synthetic oligonucleotide"
uuaaggguacacaaaacccu

SEQ ID NO: 10252 - RNA, 20 nt, Artificial Sequence
  source: /note="Description of Artificial Sequence: Synthetic oligonucleotide"
gguuuuaaggguacacaaaa

SEQ ID NO: 10253 - RNA, 20 nt, Artificial Sequence
  source: /note="Description of Artificial Sequence: Synthetic oligonucleotide"
ggguuuuaaggguacacaaa

SEQ ID NO: 10254 - RNA, 20 nt, Artificial Sequence
  source: /note="Description of Artificial Sequence: Synthetic oligonucleotide"
gagaugcugcacuauaccag

SEQ ID NO: 10255 - RNA, 20 nt, Artificial Sequence
  source: /note="Description of Artificial Sequence: Synthetic oligonucleotide"
aacaugagaugcugcacuau

SEQ ID NO: 10256 - RNA, 20 nt, Artificial Sequence
  source: /note="Description of Artificial Sequence: Synthetic oligonucleotide"
aaagcaggucacuuugcaac

SEQ ID NO: 10257 - RNA, 20 nt, Artificial Sequence
  source: /note="Description of Artificial Sequence: Synthetic oligonucleotide"
agugcuaguuaugccaaagc

SEQ ID NO: 10258 - RNA, 20 nt, Artificial Sequence
  source: /note="Description of Artificial Sequence: Synthetic oligonucleotide"
ugcuugucaacacaauugac

SEQ ID NO: 10259 - RNA, 20 nt, Artificial Sequence
  source: /note="Description of Artificial Sequence: Synthetic oligonucleotide"
acugguuuagauuaacacca

SEQ ID NO: 10260 - RNA, 20 nt, Artificial Sequence
  source: /note="Description of Artificial Sequence: Synthetic oligonucleotide"
aacuggcaaugcauagucac

SEQ ID NO: 10261 - RNA, 20 nt, Artificial Sequence
  source: /note="Description of Artificial Sequence: Synthetic oligonucleotide"
uccuggaaguuaacuguaac

SEQ ID NO: 10262 - RNA, 20 nt, Artificial Sequence
  source: /note="Description of Artificial Sequence: Synthetic oligonucleotide"
acugaauuuugagauuuucc

SEQ ID NO: 10263 - RNA, 20 nt, Artificial Sequence
  source: /note="Description of Artificial Sequence: Synthetic oligonucleotide"
auuacaaucuaccagguaac

SEQ ID NO: 10264 - RNA, 20 nt, Artificial Sequence
  source: /note="Description of Artificial Sequence: Synthetic oligonucleotide"
uuaacugauuacaaucuacc

SEQ ID NO: 10265 - RNA, 20 nt, Artificial Sequence
  source: /note="Description of Artificial Sequence: Synthetic oligonucleotide"
uaaggugaauggcuuguauu

SEQ ID NO: 10266 - RNA, 20 nt, Artificial Sequence
  source: /note="Description of Artificial Sequence: Synthetic oligonucleotide"
uucucucucuguaaggugaa

SEQ ID NO: 10267 - RNA, 20 nt, Artificial Sequence
  source: /note="Description of Artificial Sequence: Synthetic oligonucleotide"
aauaugcuucucucucugua

SEQ ID NO: 10268 - RNA, 20 nt, Artificial Sequence
  source: /note="Description of Artificial Sequence: Synthetic oligonucleotide"
uuuaugcuucucucucugua

SEQ ID NO: 10269 - RNA, 20 nt, Artificial Sequence
  source: /note="Description of Artificial Sequence: Synthetic oligonucleotide"
cacugugaaucuuuuacaau

SEQ ID NO: 10270 - RNA, 20 nt, Artificial Sequence
  source: /note="Description of Artificial Sequence: Synthetic oligonucleotide"
acccacuguaauauguaguc

SEQ ID NO: 10271 - RNA, 20 nt, Artificial Sequence
  source: /note="Description of Artificial Sequence: Synthetic oligonucleotide"
uuauacccugaacccuuugu

SEQ ID NO: 10272 - RNA, 20 nt, Artificial Sequence
  source: /note="Description of Artificial Sequence: Synthetic oligonucleotide"
uuguucuuuaucucuacucu

SEQ ID NO: 10273 - RNA, 20 nt, Artificial Sequence
  source: /note="Description of Artificial Sequence: Synthetic oligonucleotide"
uuuguucuuuaucucuacuc

SEQ ID NO: 10274 - RNA, 20 nt, Artificial Sequence
  source: /note="Description of Artificial Sequence: Synthetic oligonucleotide"
auccauguugauaauucauu

SEQ ID NO: 10275 - RNA, 20 nt, Artificial Sequence
  source: /note="Description of Artificial Sequence: Synthetic oligonucleotide"
uuacacugucuuuaggauac

SEQ ID NO: 10276 - RNA, 20 nt, Artificial Sequence
  source: /note="Description of Artificial Sequence: Synthetic oligonucleotide"
cuuaccaaaaauguaaaagu

SEQ ID NO: 10277 - RNA, 20 nt, Artificial Sequence
  source: /note="Description of Artificial Sequence: Synthetic oligonucleotide"
auaccggucauuugauucuu

SEQ ID NO: 10278 - RNA, 20 nt, Artificial Sequence
  source: /note="Description of Artificial Sequence: Synthetic oligonucleotide"
ggagugucgaacacaaacau

SEQ ID NO: 10279 - RNA, 20 nt, Artificial Sequence
  source: /note="Description of Artificial Sequence: Synthetic oligonucleotide"
ucaauccuuuggucuuggau

SEQ ID NO: 10280 - RNA, 20 nt, Artificial Sequence
  source: /note="Description of Artificial Sequence: Synthetic oligonucleotide"
guucuucuggaugucuucaa

SEQ ID NO: 10281 - RNA, 20 nt, Artificial Sequence
  source: /note="Description of Artificial Sequence: Synthetic oligonucleotide"
aggccuuguguuuguucuuc

SEQ ID NO: 10282 - RNA, 20 nt, Artificial Sequence
  source: /note="Description of Artificial Sequence: Synthetic oligonucleotide"
uagauguuggggugguuggu

SEQ ID NO: 10283 - RNA, 20 nt, Artificial Sequence
  source: /note="Description of Artificial Sequence: Synthetic oligonucleotide"
auuuuagauguugggguggu

SEQ ID NO: 10284 - RNA, 20 nt, Artificial Sequence
  source: /note="Description of Artificial Sequence: Synthetic oligonucleotide"
gaugauuuuagauguugggg

SEQ ID NO: 10285 - RNA, 20 nt, Artificial Sequence
  source: /note="Description of Artificial Sequence: Synthetic oligonucleotide"
agugaugauuuuagauguug

SEQ ID NO: 10286 - RNA, 20 nt, Artificial Sequence
  source: /note="Description of Artificial Sequence: Synthetic oligonucleotide"
uagugaugauuuuagauguu

SEQ ID NO: 10287 - RNA, 20 nt, Artificial Sequence
  source: /note="Description of Artificial Sequence: Synthetic oligonucleotide"
uuagugaugauuuuagaugu

SEQ ID NO: 10288 - RNA, 20 nt, Artificial Sequence
  source: /note="Description of Artificial Sequence: Synthetic oligonucleotide"
auagccuccuaauaaugagc

SEQ ID NO: 10289 - RNA, 20 nt, Artificial Sequence
  source: /note="Description of Artificial Sequence: Synthetic oligonucleotide"
gaaugaaacaugguuauauu

SEQ ID NO: 10290 - RNA, 20 nt, Artificial Sequence
  source: /note="Description of Artificial Sequence: Synthetic oligonucleotide"
caccuuccuggaaugaaaca

SEQ ID NO: 10291 - RNA, 20 nt, Artificial Sequence
  source: /note="Description of Artificial Sequence: Synthetic oligonucleotide"
cuuacucucugucaccuucc

SEQ ID NO: 10292 - RNA, 20 nt, Artificial Sequence
  source: /note="Description of Artificial Sequence: Synthetic oligonucleotide"
cagaacccaugcucuaucag

SEQ ID NO: 10293 - RNA, 20 nt, Artificial Sequence
  source: /note="Description of Artificial Sequence: Synthetic oligonucleotide"
gaaauaacuucaacaugaga

SEQ ID NO: 10294 - RNA, 20 nt, Artificial Sequence
  source: /note="Description of Artificial Sequence: Synthetic oligonucleotide"
ugagagaaaugugaucacaa

SEQ ID NO: 10295 - RNA, 20 nt, Artificial Sequence
  source: /note="Description of Artificial Sequence: Synthetic oligonucleotide"
uauuuaguguuuuugaucaa

SEQ ID NO: 10296 - RNA, 20 nt, Artificial Sequence
  source: /note="Description of Artificial Sequence: Synthetic oligonucleotide"
cuuugguaaaagauuauuug

SEQ ID NO: 10297 - RNA, 20 nt, Artificial Sequence
  source: /note="Description of Artificial Sequence: Synthetic oligonucleotide"
uacuacaauuacacuagcuu

SEQ ID NO: 10298 - RNA, 20 nt, Artificial Sequence
  source: /note="Description of Artificial Sequence: Synthetic oligonucleotide"
cuguugcuuugauaauuaaa

SEQ ID NO: 10299 - RNA, 20 nt, Artificial Sequence
  source: /note="Description of Artificial Sequence: Synthetic oligonucleotide"
aaaggguaagggguggaggg

SEQ ID NO: 10300 - RNA, 20 nt, Artificial Sequence
  source: /note="Description of Artificial Sequence: Synthetic oligonucleotide"
ugaaaaggguaaggggugga

SEQ ID NO: 10301 - RNA, 20 nt, Artificial Sequence
  source: /note="Description of Artificial Sequence: Synthetic oligonucleotide"
cugaaaaggguaaggggugg

SEQ ID NO: 10302 - RNA, 20 nt, Artificial Sequence
  source: /note="Description of Artificial Sequence: Synthetic oligonucleotide"
acucugaaaaggguaagggg

SEQ ID NO: 10303 - RNA, 20 nt, Artificial Sequence
  source: /note="Description of Artificial Sequence: Synthetic oligonucleotide"
gguacucugaaaaggguaag

SEQ ID NO: 10304 - RNA, 20 nt, Artificial Sequence
  source: /note="Description of Artificial Sequence: Synthetic oligonucleotide"
ggguacucugaaaaggguaa

SEQ ID NO: 10305 - RNA, 20 nt, Artificial Sequence
  source: /note="Description of Artificial Sequence: Synthetic oligonucleotide"
uggguacucugaaaagggua

SEQ ID NO: 10306 - RNA, 20 nt, Artificial Sequence
  source: /note="Description of Artificial Sequence: Synthetic oligonucleotide"
auaaguggguacucugaaaa

SEQ ID NO: 10307 - RNA, 20 nt, Artificial Sequence
  source: /note="Description of Artificial Sequence: Synthetic oligonucleotide"
uauaaguggguacucugaaa

SEQ ID NO: 10308 - RNA, 20 nt, Artificial Sequence
  source: /note="Description of Artificial Sequence: Synthetic oligonucleotide"
ugaaauaugaccauauaagu

SEQ ID NO: 10309 - RNA, 20 nt, Artificial Sequence
  source: /note="Description of Artificial Sequence: Synthetic oligonucleotide"
cugaaauaugaccauauaag

SEQ ID NO: 10310 - RNA, 20 nt, Artificial Sequence
  source: /note="Description of Artificial Sequence: Synthetic oligonucleotide"
gguaaagauuuggcugauac

SEQ ID NO: 10311 - RNA, 20 nt, Artificial Sequence
  source: /note="Description of Artificial Sequence: Synthetic oligonucleotide"
aaaaugaaaagguaaagauu

SEQ ID NO: 10312 - RNA, 20 nt, Artificial Sequence
  source: /note="Description of Artificial Sequence: Synthetic oligonucleotide"
uaaaaauauaaaaaaugaaa

SEQ ID NO: 10313 - RNA, 20 nt, Artificial Sequence
  source: /note="Description of Artificial Sequence: Synthetic oligonucleotide"
gaaaugacuuccucuguuuu

SEQ ID NO: 10314 - RNA, 20 nt, Artificial Sequence
  source: /note="Description of Artificial Sequence: Synthetic oligonucleotide"
ugugaagccucuucaaaaac

SEQ ID NO: 10315 - RNA, 20 nt, Artificial Sequence
  source: /note="Description of Artificial Sequence: Synthetic oligonucleotide"
ucacauauguuucugucuau

SEQ ID NO: 10316 - RNA, 20 nt, Artificial Sequence
  source: /note="Description of Artificial Sequence: Synthetic oligonucleotide"
uucacauauguuucugucua

SEQ ID NO: 10317 - RNA, 20 nt, Artificial Sequence
  source: /note="Description of Artificial Sequence: Synthetic oligonucleotide"
cuaucaggaacaguuagcug

SEQ ID NO: 10318 - RNA, 20 nt, Artificial Sequence
  source: /note="Description of Artificial Sequence: Synthetic oligonucleotide"
acccuuucucugagucuauc

SEQ ID NO: 10319 - RNA, 20 nt, Artificial Sequence
  source: /note="Description of Artificial Sequence: Synthetic oligonucleotide"
aauagcaacaaaaugguaca

SEQ ID NO: 10320 - RNA, 20 nt, Artificial Sequence
  source: /note="Description of Artificial Sequence: Synthetic oligonucleotide"
aaauagcaacaaaaugguac

SEQ ID NO: 10321 - RNA, 20 nt, Artificial Sequence
  source: /note="Description of Artificial Sequence: Synthetic oligonucleotide"
uaaugaaaauagcaacaaaa

SEQ ID NO: 10322 - RNA, 20 nt, Artificial Sequence
  source: /note="Description of Artificial Sequence: Synthetic oligonucleotide"
aguauucagauuuguguugg

SEQ ID NO: 10323 - RNA, 20 nt, Artificial Sequence
  source: /note="Description of Artificial Sequence: Synthetic oligonucleotide"
cucaguauucagauuugugu

SEQ ID NO: 10324 - RNA, 20 nt, Artificial Sequence
  source: /note="Description of Artificial Sequence: Synthetic oligonucleotide"
gacauuacagccucaacuac

SEQ ID NO: 10325 - RNA, 20 nt, Artificial Sequence
  source: /note="Description of Artificial Sequence: Synthetic oligonucleotide"
uuguagauaaauguguugug

SEQ ID NO: 10326 - RNA, 20 nt, Artificial Sequence
  source: /note="Description of Artificial Sequence: Synthetic oligonucleotide"
auuaaaaaugaaaauuauuu

SEQ ID NO: 10327 - RNA, 20 nt, Artificial Sequence
  source: /note="Description of Artificial Sequence: Synthetic oligonucleotide"
ccccaucaacuuguaaguuc

SEQ ID NO: 10328 - RNA, 20 nt, Artificial Sequence
  source: /note="Description of Artificial Sequence: Synthetic oligonucleotide"
cccaucaacuuguaaguucu

SEQ ID NO: 10329 - RNA, 20 nt, Artificial Sequence
  source: /note="Description of Artificial Sequence: Synthetic oligonucleotide"
ccaucaacuuguaaguucug

SEQ ID NO: 10330 - RNA, 20 nt, Artificial Sequence
  source: /note="Description of Artificial Sequence: Synthetic oligonucleotide"
aaguucugggguacacaugc

SEQ ID NO: 10331 - RNA, 20 nt, Artificial Sequence
  source: /note="Description of Artificial Sequence: Synthetic oligonucleotide"
gguacacaugcaggaugugc

SEQ ID NO: 10332 - RNA, 20 nt, Artificial Sequence
  source: /note="Description of Artificial Sequence: Synthetic oligonucleotide"
gaugugcagguuuguuauac

SEQ ID NO: 10333 - RNA, 20 nt, Artificial Sequence
  source: /note="Description of Artificial Sequence: Synthetic oligonucleotide"
auacagguaaacaugugcca

SEQ ID NO: 10334 - RNA, 20 nt, Artificial Sequence
  source: /note="Description of Artificial Sequence: Synthetic oligonucleotide"
cacagaucaacccauuaccu

SEQ ID NO: 10335 - RNA, 20 nt, Artificial Sequence
  source: /note="Description of Artificial Sequence: Synthetic oligonucleotide"
ccugaugcaccccuaccaau

SEQ ID NO: 10336 - RNA, 20 nt, Artificial Sequence
  source: /note="Description of Artificial Sequence: Synthetic oligonucleotide"
aaaaugaacauuguuaauuu

SEQ ID NO: 10337 - RNA, 20 nt, Artificial Sequence
  source: /note="Description of Artificial Sequence: Synthetic oligonucleotide"
uuggaaaguuauaucaauca

SEQ ID NO: 10338 - RNA, 20 nt, Artificial Sequence
  source: /note="Description of Artificial Sequence: Synthetic oligonucleotide"
gagucuucucuaaaguagca

SEQ ID NO: 10339 - RNA, 20 nt, Artificial Sequence
  source: /note="Description of Artificial Sequence: Synthetic oligonucleotide"
agucuucucuaaaguagcaa

SEQ ID NO: 10340 - RNA, 20 nt, Artificial Sequence
  source: /note="Description of Artificial Sequence: Synthetic oligonucleotide"
ucucuaaaguagcaagggcc

SEQ ID NO: 10341 - RNA, 20 nt, Artificial Sequence
  source: /note="Description of Artificial Sequence: Synthetic oligonucleotide"
ccaggcuuuguucucagaga

SEQ ID NO: 10342 - RNA, 20 nt, Artificial Sequence
  source: /note="Description of Artificial Sequence: Synthetic oligonucleotide"
gagauauugcaccaucaaca

SEQ ID NO: 10343 - RNA, 20 nt, Artificial Sequence
  source: /note="Description of Artificial Sequence: Synthetic oligonucleotide"
caccaucaacauggaaaaca

SEQ ID NO: 10344 - RNA, 20 nt, Artificial Sequence
  source: /note="Description of Artificial Sequence: Synthetic oligonucleotide"
auggaaaacauggaaaaguc

SEQ ID NO: 10345 - RNA, 20 nt, Artificial Sequence
  source: /note="Description of Artificial Sequence: Synthetic oligonucleotide"
aaacagcaacuuuuuuuaac

SEQ ID NO: 10346 - RNA, 20 nt, Artificial Sequence
  source: /note="Description of Artificial Sequence: Synthetic oligonucleotide"
cgaugaaauucauuguaauu

SEQ ID NO: 10347 - RNA, 20 nt, Artificial Sequence
  source: /note="Description of Artificial Sequence: Synthetic oligonucleotide"
auucauuguaauuuggcagu

SEQ ID NO: 10348 - RNA, 20 nt, Artificial Sequence
  source: /note="Description of Artificial Sequence: Synthetic oligonucleotide"
gcaguaggccaaauuaguag

SEQ ID NO: 10349 - RNA, 20 nt, Artificial Sequence
  source: /note="Description of Artificial Sequence: Synthetic oligonucleotide"
uaguagaggagcuaauaguu

SEQ ID NO: 10350 - RNA, 20 nt, Artificial Sequence
  source: /note="Description of Artificial Sequence: Synthetic oligonucleotide"
aacacaguaaaccagaacug

SEQ ID NO: 10351 - RNA, 20 nt, Artificial Sequence
  source: /note="Description of Artificial Sequence: Synthetic oligonucleotide"
aacaagaccuugaauuuugu

SEQ ID NO: 10352 - RNA, 20 nt, Artificial Sequence
  source: /note="Description of Artificial Sequence: Synthetic oligonucleotide"
gcaaaugagcucuuccaaaa

SEQ ID NO: 10353 - RNA, 20 nt, Artificial Sequence
  source: /note="Description of Artificial Sequence: Synthetic oligonucleotide"
caaaugagcucuuccaaaau

SEQ ID NO: 10354 - RNA, 20 nt, Artificial Sequence
  source: /note="Description of Artificial Sequence: Synthetic oligonucleotide"
augggaaaaagaaaauacau

SEQ ID NO: 10355 - RNA, 20 nt, Artificial Sequence
  source: /note="Description of Artificial Sequence: Synthetic oligonucleotide"
auacauuggugacaaaacac

SEQ ID NO: 10356 - RNA, 20 nt, Artificial Sequence
  source: /note="Description of Artificial Sequence: Synthetic oligonucleotide"
uaaacuuaaccuacuguuuu

SEQ ID NO: 10357 - RNA, 20 nt, Artificial Sequence
  source: /note="Description of Artificial Sequence: Synthetic oligonucleotide"
aauaugauugagagagagag

SEQ ID NO: 10358 - RNA, 20 nt, Artificial Sequence
  source: /note="Description of Artificial Sequence: Synthetic oligonucleotide"
auaugauugagagagagaga

SEQ ID NO: 10359 - RNA, 20 nt, Artificial Sequence
  source: /note="Description of Artificial Sequence: Synthetic oligonucleotide"
uaugauugagagagagagag

SEQ ID NO: 10360 - RNA, 20 nt, Artificial Sequence
  source: /note="Description of Artificial Sequence: Synthetic oligonucleotide"
ccuuagacauguugagucug

SEQ ID NO: 10361 - RNA, 20 nt, Artificial Sequence
  source: /note="Description of Artificial Sequence: Synthetic oligonucleotide"
acauguugagucugugguuu

SEQ ID NO: 10362 - RNA, 20 nt, Artificial Sequence
  source: /note="Description of Artificial Sequence: Synthetic oligonucleotide"
uguugagucugugguuuagg

SEQ ID NO: 10363 - RNA, 20 nt, Artificial Sequence
  source: /note="Description of Artificial Sequence: Synthetic oligonucleotide"
guugagucugugguuuagga

SEQ ID NO: 10364 - RNA, 20 nt, Artificial Sequence
  source: /note="Description of Artificial Sequence: Synthetic oligonucleotide"
uugagucugugguuuaggag

SEQ ID NO: 10365 - RNA, 20 nt, Artificial Sequence
  source: /note="Description of Artificial Sequence: Synthetic oligonucleotide"
aagaaaaaaaauccaaaauu

SEQ ID NO: 10366 - RNA, 20 nt, Artificial Sequence
  source: /note="Description of Artificial Sequence: Synthetic oligonucleotide"
agaaaaaaaauccaaaauuu

SEQ ID NO: 10367 - RNA, 20 nt, Artificial Sequence
  source: /note="Description of Artificial Sequence: Synthetic oligonucleotide"
aaaaaauccaaaauuuggga

SEQ ID NO: 10368 - RNA, 20 nt, Artificial Sequence
  source: /note="Description of Artificial Sequence: Synthetic oligonucleotide"
uccaaaauuugggaugguau

SEQ ID NO: 10369 - RNA, 20 nt, Artificial Sequence
  source: /note="Description of Artificial Sequence: Synthetic oligonucleotide"
aauuugggaugguauuggcc

SEQ ID NO: 10370 - RNA, 20 nt, Artificial Sequence
  source: /note="Description of Artificial Sequence: Synthetic oligonucleotide"
ugauucauuuccaagcucag

SEQ ID NO: 10371 - RNA, 20 nt, Artificial Sequence
  source: /note="Description of Artificial Sequence: Synthetic oligonucleotide"
cuugauaaguguuuauugac

SEQ ID NO: 10372 - RNA, 20 nt, Artificial Sequence
  source: /note="Description of Artificial Sequence: Synthetic oligonucleotide"
uaaguaaauacuguucacuu

SEQ ID NO: 10373 - RNA, 20 nt, Artificial Sequence
  source: /note="Description of Artificial Sequence: Synthetic oligonucleotide"
ugucucugcucccuuuuaac

SEQ ID NO: 10374 - RNA, 20 nt, Artificial Sequence
  source: /note="Description of Artificial Sequence: Synthetic oligonucleotide"
cccuuuuaacuggcuucugc

SEQ ID NO: 10375 - RNA, 20 nt, Artificial Sequence
  source: /note="Description of Artificial Sequence: Synthetic oligonucleotide"
ucauaugacuuuuuaaagug

SEQ ID NO: 10376 - RNA, 20 nt, Artificial Sequence
  source: /note="Description of Artificial Sequence: Synthetic oligonucleotide"
aacuguguuaacuuccuuuc

SEQ ID NO: 10377 - RNA, 20 nt, Artificial Sequence
  source: /note="Description of Artificial Sequence: Synthetic oligonucleotide"
agcaaauuccauugcaugcc

SEQ ID NO: 10378 - RNA, 20 nt, Artificial Sequence
  source: /note="Description of Artificial Sequence: Synthetic oligonucleotide"
aaacauuuuccuucccauuu

SEQ ID NO: 10379 - RNA, 20 nt, Artificial Sequence
  source: /note="Description of Artificial Sequence: Synthetic oligonucleotide"
uuuaggaauuuacuuaccag

SEQ ID NO: 10380 - RNA, 20 nt, Artificial Sequence
  source: /note="Description of Artificial Sequence: Synthetic oligonucleotide"
uuaggaauuuacuuaccagu

SEQ ID NO: 10381 - RNA, 20 nt, Artificial Sequence
  source: /note="Description of Artificial Sequence: Synthetic oligonucleotide"
uaggaauuuacuuaccagug

SEQ ID NO: 10382 - RNA, 20 nt, Artificial Sequence
  source: /note="Description of Artificial Sequence: Synthetic oligonucleotide"
aggaauuuacuuaccagugg

SEQ ID NO: 10383 - RNA, 20 nt, Artificial Sequence
  source: /note="Description of Artificial Sequence: Synthetic oligonucleotide"
uuaccagugggggugaagag

SEQ ID NO: 10384 - RNA, 20 nt, Artificial Sequence
  source: /note="Description of Artificial Sequence: Synthetic oligonucleotide"
uaccagugggggugaagaga

SEQ ID NO: 10385 - RNA, 20 nt, Artificial Sequence
  source: /note="Description of Artificial Sequence: Synthetic oligonucleotide"
uacaaaagcacuagaagaug

SEQ ID NO: 10386 - RNA, 20 nt, Artificial Sequence
  source: /note="Description of Artificial Sequence: Synthetic oligonucleotide"
acuagaagaugaggucaaag

SEQ ID NO: 10387 - RNA, 20 nt, Artificial Sequence
  source: /note="Description of Artificial Sequence: Synthetic oligonucleotide"
gaggucaaagcggucccuug

SEQ ID NO: 10388 - RNA, 20 nt, Artificial Sequence
  source: /note="Description of Artificial Sequence: Synthetic oligonucleotide"
ucaaagcggucccuugagga

SEQ ID NO: 10389 - RNA, 20 nt, Artificial Sequence
  source: /note="Description of Artificial Sequence: Synthetic oligonucleotide"
caaagcggucccuugaggaa

SEQ ID NO: 10390 - RNA, 20 nt, Artificial Sequence
  source: /note="Description of Artificial Sequence: Synthetic oligonucleotide"
aggaagggaugacuacacca

SEQ ID NO: 10391 - RNA, 20 nt, Artificial Sequence
  source: /note="Description of Artificial Sequence: Synthetic oligonucleotide"
agggaugacuacaccaagga

SEQ ID NO: 10392 - RNA, 20 nt, Artificial Sequence
  source: /note="Description of Artificial Sequence: Synthetic oligonucleotide"
ugacuacaccaaggaaggau

SEQ ID NO: 10393 - RNA, 20 nt, Artificial Sequence
  source: /note="Description of Artificial Sequence: Synthetic oligonucleotide"
gacuacaccaaggaaggaua

SEQ ID NO: 10394 - RNA, 20 nt, Artificial Sequence
  source: /note="Description of Artificial Sequence: Synthetic oligonucleotide"
ccaaggaaggauagggagag

SEQ ID NO: 10395 - RNA, 20 nt, Artificial Sequence
  source: /note="Description of Artificial Sequence: Synthetic oligonucleotide"
caaggaaggauagggagaga

SEQ ID NO: 10396 - RNA, 20 nt, Artificial Sequence
  source: /note="Description of Artificial Sequence: Synthetic oligonucleotide"
ggaaggauagggagagaggg

SEQ ID NO: 10397 - RNA, 20 nt, Artificial Sequence
  source: /note="Description of Artificial Sequence: Synthetic oligonucleotide"
auagggagagagggaggaaa

SEQ ID NO: 10398 - RNA, 20 nt, Artificial Sequence
  source: /note="Description of Artificial Sequence: Synthetic oligonucleotide"
uagggagagagggaggaaaa

SEQ ID NO: 10399 - RNA, 20 nt, Artificial Sequence
  source: /note="Description of Artificial Sequence: Synthetic oligonucleotide"
ggagagagggaggaaaaggg

SEQ ID NO: 10400 - RNA, 20 nt, Artificial Sequence
  source: /note="Description of Artificial Sequence: Synthetic oligonucleotide"
aagggaggcacuucaagcag

SEQ ID NO: 10401 - RNA, 20 nt, Artificial Sequence
  source: /note="Description of Artificial Sequence: Synthetic oligonucleotide"
aaagaacauuuugcucucaa

SEQ ID NO: 10402 - RNA, 20 nt, Artificial Sequence
  source: /note="Description of Artificial Sequence: Synthetic oligonucleotide"
acauuuugcucucaauggaa

SEQ ID NO: 10403 - RNA, 20 nt, Artificial Sequence
  source: /note="Description of Artificial Sequence: Synthetic oligonucleotide"
ugcucucaauggaauggcuu

SEQ ID NO: 10404 - RNA, 20 nt, Artificial Sequence
  source: /note="Description of Artificial Sequence: Synthetic oligonucleotide"
ccuuagacaaaaaauugugc

SEQ ID NO: 10405 - RNA, 20 nt, Artificial Sequence
  source: /note="Description of Artificial Sequence: Synthetic oligonucleotide"
uugcucuuaucuuugcuuaa

SEQ ID NO: 10406 - RNA, 20 nt, Artificial Sequence
  source: /note="Description of Artificial Sequence: Synthetic oligonucleotide"
ugcucuuaucuuugcuuaau

SEQ ID NO: 10407 - RNA, 20 nt, Artificial Sequence
  source: /note="Description of Artificial Sequence: Synthetic oligonucleotide"
ugggugucguauaucacuag

SEQ ID NO: 10408 - RNA, 20 nt, Artificial Sequence
  source: /note="Description of Artificial Sequence: Synthetic oligonucleotide"
gucuugaauguuguugaugg

SEQ ID NO: 10409 - RNA, 20 nt, Artificial Sequence
  source: /note="Description of Artificial Sequence: Synthetic oligonucleotide"
ggucuugaauguuguugaug

SEQ ID NO: 10410 - RNA, 20 nt, Artificial Sequence
  source: /note="Description of Artificial Sequence: Synthetic oligonucleotide"
gggucuugaauguuguugau

SEQ ID NO: 10411 - RNA, 20 nt, Artificial Sequence
  source: /note="Description of Artificial Sequence: Synthetic oligonucleotide"
ggggucuugaauguuguuga

SEQ ID NO: 10412 - RNA, 20 nt, Artificial Sequence
  source: /note="Description of Artificial Sequence: Synthetic oligonucleotide"
uagacacgucguuuaguggu

SEQ ID NO: 10413 - RNA, 20 nt, Artificial Sequence
  source: /note="Description of Artificial Sequence: Synthetic oligonucleotide"
cccgaauuauggauccauua

SEQ ID NO: 10414 - RNA, 20 nt, Artificial Sequence
  source: /note="Description of Artificial Sequence: Synthetic oligonucleotide"
acccgaauuauggauccauu

SEQ ID NO: 10415 - RNA, 20 nt, Artificial Sequence
  source: /note="Description of Artificial Sequence: Synthetic oligonucleotide"
ucuacgacccgaauuaugga

SEQ ID NO: 10416 - RNA, 20 nt, Artificial Sequence
  source: /note="Description of Artificial Sequence: Synthetic oligonucleotide"
cccacguaguccuucuacga

SEQ ID NO: 10417 - RNA, 20 nt, Artificial Sequence
  source: /note="Description of Artificial Sequence: Synthetic oligonucleotide"
ccccacguaguccuucuacg

SEQ ID NO: 10418 - RNA, 20 nt, Artificial Sequence
  source: /note="Description of Artificial Sequence: Synthetic oligonucleotide"
ggauaaccauccccacguag

SEQ ID NO: 10419 - RNA, 20 nt, Artificial Sequence
  source: /note="Description of Artificial Sequence: Synthetic oligonucleotide"
ugugaccgcggauaaccauc

SEQ ID NO: 10420 - RNA, 20 nt, Artificial Sequence
  source: /note="Description of Artificial Sequence: Synthetic oligonucleotide"
gugugaccgcggauaaccau

SEQ ID NO: 10421 - RNA, 20 nt, Artificial Sequence
  source: /note="Description of Artificial Sequence: Synthetic oligonucleotide"
ugugugaccgcggauaacca

SEQ ID NO: 10422 - RNA, 20 nt, Artificial Sequence
  source: /note="Description of Artificial Sequence: Synthetic oligonucleotide"
guugugugugaccgcggaua

SEQ ID NO: 10423 - RNA, 20 nt, Artificial Sequence
  source: /note="Description of Artificial Sequence: Synthetic oligonucleotide"
ccucaccccuguugugugug

SEQ ID NO: 10424 - RNA, 20 nt, Artificial Sequence
  source: /note="Description of Artificial Sequence: Synthetic oligonucleotide"
ccuguguaccacccccucac

SEQ ID NO: 10425 - RNA, 20 nt, Artificial Sequence
  source: /note="Description of Artificial Sequence: Synthetic oligonucleotide"
accuguguaccacccccuca

SEQ ID NO: 10426 - RNA, 20 nt, Artificial Sequence
  source: /note="Description of Artificial Sequence: Synthetic oligonucleotide"
uaccuguguaccacccccuc

SEQ ID NO: 10427 - RNA, 20 nt, Artificial Sequence
  source: /note="Description of Artificial Sequence: Synthetic oligonucleotide"
ucguguaccuguguaccacc

SEQ ID NO: 10428 - RNA, 20 nt, Artificial Sequence
  source: /note="Description of Artificial Sequence: Synthetic oligonucleotide"
cucguguaccuguguaccac

SEQ ID NO: 10429 - RNA, 20 nt, Artificial Sequence
  source: /note="Description of Artificial Sequence: Synthetic oligonucleotide"
ucucguguaccuguguacca

SEQ ID NO: 10430 - RNA, 20 nt, Artificial Sequence
  source: /note="Description of Artificial Sequence: Synthetic oligonucleotide"
uucucguguaccuguguacc

SEQ ID NO: 10431 - RNA, 20 nt, Artificial Sequence
  source: /note="Description of Artificial Sequence: Synthetic oligonucleotide"
auauucucguguaccugugu

SEQ ID NO: 10432 - RNA, 20 nt, Artificial Sequence
  source: /note="Description of Artificial Sequence: Synthetic oligonucleotide"
cauuuuacauauucucgugu

SEQ ID NO: 10433 - RNA, 20 nt, Artificial Sequence
  source: /note="Description of Artificial Sequence: Synthetic oligonucleotide"
ugcuacuuuagagaagacuc

SEQ ID NO: 10434 - RNA, 20 nt, Artificial Sequence
  source: /note="Description of Artificial Sequence: Synthetic oligonucleotide"
ccaucucugagaacaaagcc

SEQ ID NO: 10435 - RNA, 20 nt, Artificial Sequence
  source: /note="Description of Artificial Sequence: Synthetic oligonucleotide"
uuccauguuuuccauguuga

SEQ ID NO: 10436 - RNA, 20 nt, Artificial Sequence
  source: /note="Description of Artificial Sequence: Synthetic oligonucleotide"
uauuagcuccucuacuaauu

SEQ ID NO: 10437 - RNA, 20 nt, Artificial Sequence
  source: /note="Description of Artificial Sequence: Synthetic oligonucleotide"
aggucuuguuaccucaguuc

SEQ ID NO: 10438 - RNA, 20 nt, Artificial Sequence
  source: /note="Description of Artificial Sequence: Synthetic oligonucleotide"
cuacuaaccaacaaaauuca

SEQ ID NO: 10439 - RNA, 20 nt, Artificial Sequence
  source: /note="Description of Artificial Sequence: Synthetic oligonucleotide"
guauuuucuuuuucccauuu

SEQ ID NO: 10440 - RNA, 20 nt, Artificial Sequence
  source: /note="Description of Artificial Sequence: Synthetic oligonucleotide"
acaaauccaaauuuugaaac

SEQ ID NO: 10441 - RNA, 20 nt, Artificial Sequence
  source: /note="Description of Artificial Sequence: Synthetic oligonucleotide"
aacaaauccaaauuuugaaa

SEQ ID NO: 10442 - RNA, 20 nt, Artificial Sequence
  source: /note="Description of Artificial Sequence: Synthetic oligonucleotide"
uaacaaauccaaauuuugaa

SEQ ID NO: 10443 - RNA, 20 nt, Artificial Sequence
  source: /note="Description of Artificial Sequence: Synthetic oligonucleotide"
uaaaacaguagguuaacaaa

SEQ ID NO: 10444 - RNA, 20 nt, Artificial Sequence
  source: /note="Description of Artificial Sequence: Synthetic oligonucleotide"
uuuuagaaaccuaaaacagu

SEQ ID NO: 10445 - RNA, 20 nt, Artificial Sequence
  source: /note="Description of Artificial Sequence: Synthetic oligonucleotide"
ccacagacucaacaugucua

SEQ ID NO: 10446 - RNA, 20 nt, Artificial Sequence
  source: /note="Description of Artificial Sequence: Synthetic oligonucleotide"
cagcuguaaucuauuuugau

SEQ ID NO: 10447 - RNA, 20 nt, Artificial Sequence
  source: /note="Description of Artificial Sequence: Synthetic oligonucleotide"
acagcuguaaucuauuuuga

SEQ ID NO: 10448 - RNA, 20 nt, Artificial Sequence
  source: /note="Description of Artificial Sequence: Synthetic oligonucleotide"
agacauaaagcaggaggcua

SEQ ID NO: 10449 - RNA, 20 nt, Artificial Sequence
  source: /note="Description of Artificial Sequence: Synthetic oligonucleotide"
aacugcagacauaaagcagg

SEQ ID NO: 10450 - RNA, 20 nt, Artificial Sequence
  source: /note="Description of Artificial Sequence: Synthetic oligonucleotide"
acaaacugcagacauaaagc

SEQ ID NO: 10451 - RNA, 20 nt, Artificial Sequence
  source: /note="Description of Artificial Sequence: Synthetic oligonucleotide"
gccaauaccaucccaaauuu

SEQ ID NO: 10452 - RNA, 20 nt, Artificial Sequence
  source: /note="Description of Artificial Sequence: Synthetic oligonucleotide"
guuugcuuuuguuaauggcc

SEQ ID NO: 10453 - RNA, 20 nt, Artificial Sequence
  source: /note="Description of Artificial Sequence: Synthetic oligonucleotide"
aacugguuugcuuuuguuaa

SEQ ID NO: 10454 - RNA, 20 nt, Artificial Sequence
  source: /note="Description of Artificial Sequence: Synthetic oligonucleotide"
auggcuaguuuuaagcaaac

SEQ ID NO: 10455 - RNA, 20 nt, Artificial Sequence
  source: /note="Description of Artificial Sequence: Synthetic oligonucleotide"
acuucaugaagcagcaaaga

SEQ ID NO: 10456 - RNA, 20 nt, Artificial Sequence
  source: /note="Description of Artificial Sequence: Synthetic oligonucleotide"
uaacuuaguuccucugagcu

SEQ ID NO: 10457 - RNA, 20 nt, Artificial Sequence
  source: /note="Description of Artificial Sequence: Synthetic oligonucleotide"
guuaaaagggagcagagaca

SEQ ID NO: 10458 - RNA, 20 nt, Artificial Sequence
  source: /note="Description of Artificial Sequence: Synthetic oligonucleotide"
ccugcagaagccaguuaaaa

SEQ ID NO: 10459 - RNA, 20 nt, Artificial Sequence
  source: /note="Description of Artificial Sequence: Synthetic oligonucleotide"
accugcagaagccaguuaaa

SEQ ID NO: 10460 - RNA, 20 nt, Artificial Sequence
  source: /note="Description of Artificial Sequence: Synthetic oligonucleotide"
uggcaguucugagaacagaa

SEQ ID NO: 10461 - RNA, 20 nt, Artificial Sequence
  source: /note="Description of Artificial Sequence: Synthetic oligonucleotide"
auggcaguucugagaacaga

SEQ ID NO: 10462 - RNA, 20 nt, Artificial Sequence
  source: /note="Description of Artificial Sequence: Synthetic oligonucleotide"
acaaauagaugaaacugcaa

SEQ ID NO: 10463 - RNA, 20 nt, Artificial Sequence
  source: /note="Description of Artificial Sequence: Synthetic oligonucleotide"
uauaagcaggcuuuccagaa

SEQ ID NO: 10464 - RNA, 20 nt, Artificial Sequence
  source: /note="Description of Artificial Sequence: Synthetic oligonucleotide"
acaagugcuacuuuauaagc

SEQ ID NO: 10465 - RNA, 20 nt, Artificial Sequence
  source: /note="Description of Artificial Sequence: Synthetic oligonucleotide"
agauuuauuauguaagauuc

SEQ ID NO: 10466 - RNA, 20 nt, Artificial Sequence
  source: /note="Description of Artificial Sequence: Synthetic oligonucleotide"
aagauuuauuauguaagauu

SEQ ID NO: 10467 - RNA, 20 nt, Artificial Sequence
  source: /note="Description of Artificial Sequence: Synthetic oligonucleotide"
gaaguaacggaccguacguu

SEQ ID NO: 10468 - RNA, 20 nt, Artificial Sequence
  source: /note="Description of Artificial Sequence: Synthetic oligonucleotide"
aaugaaugaagaaguaacgg

SEQ ID NO: 10469 - RNA, 20 nt, Artificial Sequence
  source: /note="Description of Artificial Sequence: Synthetic oligonucleotide"
uucauuuaaggauuuacccu

SEQ ID NO: 10470 - RNA, 20 nt, Artificial Sequence
  source: /note="Description of Artificial Sequence: Synthetic oligonucleotide"
accauucauuuaaggauuua

SEQ ID NO: 10471 - RNA, 20 nt, Artificial Sequence
  source: /note="Description of Artificial Sequence: Synthetic oligonucleotide"
gaccauucauuuaaggauuu

SEQ ID NO: 10472 - RNA, 20 nt, Artificial Sequence
  source: /note="Description of Artificial Sequence: Synthetic oligonucleotide"
ucgggagagaagugggggug

SEQ ID NO: 10473 - RNA, 20 nt, Artificial Sequence
  source: /note="Description of Artificial Sequence: Synthetic oligonucleotide"
acaucaguagggaaggaguu

SEQ ID NO: 10474 - RNA, 20 nt, Artificial Sequence
  source: /note="Description of Artificial Sequence: Synthetic oligonucleotide"
cacaucaguagggaaggagu

SEQ ID NO: 10475 - RNA, 20 nt, Artificial Sequence
  source: /note="Description of Artificial Sequence: Synthetic oligonucleotide"
ggagagagggauaggaagga

SEQ ID NO: 10476 - RNA, 20 nt, Artificial Sequence
  source: /note="Description of Artificial Sequence: Synthetic oligonucleotide"
auugagagcaaaauguugaa

SEQ ID NO: 10477 - RNA, 20 nt, Artificial Sequence
  source: /note="Description of Artificial Sequence: Synthetic oligonucleotide"
ccagcacaauuuuuugucua

SEQ ID NO: 10478 - RNA, 20 nt, Artificial Sequence
  source: /note="Description of Artificial Sequence: Synthetic oligonucleotide"
caaagauaagagcaaaguca

SEQ ID NO: 10479 - RNA, 20 nt, Artificial Sequence
  source: /note="Description of Artificial Sequence: Synthetic oligonucleotide"
gcaaagauaagagcaaaguc

SEQ ID NO: 10480 - RNA, 20 nt, Artificial Sequence
  source: /note="Description of Artificial Sequence: Synthetic oligonucleotide"
uagugaggauacuuaaaugu

SEQ ID NO: 10481 - RNA, 20 nt, Artificial Sequence
  source: /note="Description of Artificial Sequence: Synthetic oligonucleotide"
uuauuuuaugaaggcuagug

SEQ ID NO: 10482 - RNA, 20 nt, Artificial Sequence
  source: /note="Description of Artificial Sequence: Synthetic oligonucleotide"
uguugaugauuauuuuauga

SEQ ID NO: 10483 - RNA, 20 nt, Artificial Sequence
  source: /note="Description of Artificial Sequence: Synthetic oligonucleotide"
cuuugucggcaagucuugac

SEQ ID NO: 10484 - RNA, 20 nt, Artificial Sequence
  source: /note="Description of Artificial Sequence: Synthetic oligonucleotide"
gucucugacguggaugaguu

SEQ ID NO: 10485 - RNA, 20 nt, Artificial Sequence
  source: /note="Description of Artificial Sequence: Synthetic oligonucleotide"
agagcaccagagugccgucu

SEQ ID NO: 10486 - RNA, 20 nt, Artificial Sequence
  source: /note="Description of Artificial Sequence: Synthetic oligonucleotide"
ucucugacguggaugaguuu

SEQ ID NO: 10487 - RNA, 20 nt, Artificial Sequence
  source: /note="Description of Artificial Sequence: Synthetic oligonucleotide"
cagucaagacuugccgacaa

SEQ ID NO: 10488 - RNA, 20 nt, Artificial Sequence
  source: /note="Description of Artificial Sequence: Synthetic oligonucleotide"
gugagagugcauaccuggua

SEQ ID NO: 10489 - RNA, 20 nt, Artificial Sequence
  source: /note="Description of Artificial Sequence: Synthetic oligonucleotide"
cucuagugagagugcauacc

SEQ ID NO: 10490 - RNA, 20 nt, Artificial Sequence
  source: /note="Description of Artificial Sequence: Synthetic oligonucleotide"
auuugagcuguucuccaggg

SEQ ID NO: 10491 - RNA, 20 nt, Artificial Sequence
  source: /note="Description of Artificial Sequence: Synthetic oligonucleotide"
cagagcaccagagugccguc

SEQ ID NO: 10492 - RNA, 20 nt, Artificial Sequence
  source: /note="Description of Artificial Sequence: Synthetic oligonucleotide"
cgcaagccaggcuaaacagu

SEQ ID NO: 10493 - RNA, 20 nt, Artificial Sequence
  source: /note="Description of Artificial Sequence: Synthetic oligonucleotide"
aaggaaggccguccauucuc

SEQ ID NO: 10494 - RNA, 20 nt, Artificial Sequence
  source: /note="Description of Artificial Sequence: Synthetic oligonucleotide"
agugagagugcauaccuggu

SEQ ID NO: 10495 - RNA, 20 nt, Artificial Sequence
  source: /note="Description of Artificial Sequence: Synthetic oligonucleotide"
aggaaggccguccauucuca

SEQ ID NO: 10496 - RNA, 20 nt, Artificial Sequence
  source: /note="Description of Artificial Sequence: Synthetic oligonucleotide"
uucagacccagacggcacuc

SEQ ID NO: 10497 - RNA, 20 nt, Artificial Sequence
  source: /note="Description of Artificial Sequence: Synthetic oligonucleotide"
acgugaagcugcucauccuc

SEQ ID NO: 10498 - RNA, 20 nt, Artificial Sequence
  source: /note="Description of Artificial Sequence: Synthetic oligonucleotide"
ggaaggccguccauucucag

SEQ ID NO: 10499 - RNA, 20 nt, Artificial Sequence
  source: /note="Description of Artificial Sequence: Synthetic oligonucleotide"
gcauguugugcaagucucug

SEQ ID NO: 10500 - RNA, 20 nt, Artificial Sequence
  source: /note="Description of Artificial Sequence: Synthetic oligonucleotide"
gacuugcacaacaugcagaa

SEQ ID NO: 10501 - RNA, 20 nt, Artificial Sequence
  source: /note="Description of Artificial Sequence: Synthetic oligonucleotide"
guuugggaguguggaagcuc

SEQ ID NO: 10502 - RNA, 20 nt, Artificial Sequence
  source: /note="Description of Artificial Sequence: Synthetic oligonucleotide"
caugcagaauggcagcacau

SEQ ID NO: 10503 - RNA, 20 nt, Artificial Sequence
  source: /note="Description of Artificial Sequence: Synthetic oligonucleotide"
cguggaugaguuugggagug

SEQ ID NO: 10504 - RNA, 20 nt, Artificial Sequence
  source: /note="Description of Artificial Sequence: Synthetic oligonucleotide"
cauguugugcaagucucugu

SEQ ID NO: 10505 - RNA, 20 nt, Artificial Sequence
  source: /note="Description of Artificial Sequence: Synthetic oligonucleotide"
ugggaguguggaagcucagg

SEQ ID NO: 10506 - RNA, 20 nt, Artificial Sequence
  source: /note="Description of Artificial Sequence: Synthetic oligonucleotide"
ugccgucugggucugaagga

SEQ ID NO: 10507 - RNA, 20 nt, Artificial Sequence
  source: /note="Description of Artificial Sequence: Synthetic oligonucleotide"
ggccuuccuucagacccaga

SEQ ID NO: 10508 - RNA, 20 nt, Artificial Sequence
  source: /note="Description of Artificial Sequence: Synthetic oligonucleotide"
gagaugcugcugauaugguc

SEQ ID NO: 10509 - RNA, 20 nt, Artificial Sequence
  source: /note="Description of Artificial Sequence: Synthetic oligonucleotide"
ccucacagcuuguguuugua

SEQ ID NO: 10510 - RNA, 20 nt, Artificial Sequence
  source: /note="Description of Artificial Sequence: Synthetic oligonucleotide"
aucuuucccaugcuguucuc

SEQ ID NO: 10511 - RNA, 20 nt, Artificial Sequence
  source: /note="Description of Artificial Sequence: Synthetic oligonucleotide"
uuugggaaggacccaguggg

SEQ ID NO: 10512 - RNA, 20 nt, Artificial Sequence
  source: /note="Description of Artificial Sequence: Synthetic oligonucleotide"
ugccuucagcuaugauugug

SEQ ID NO: 10513 - RNA, 20 nt, Artificial Sequence
  source: /note="Description of Artificial Sequence: Synthetic oligonucleotide"
gugaggccuccacagccaug

SEQ ID NO: 10514 - RNA, 20 nt, Artificial Sequence
  source: /note="Description of Artificial Sequence: Synthetic oligonucleotide"
gggagguaauugaaucaugg

SEQ ID NO: 10515 - RNA, 20 nt, Artificial Sequence
  source: /note="Description of Artificial Sequence: Synthetic oligonucleotide"
aguuaggaaaccagaaccua

SEQ ID NO: 10516 - RNA, 20 nt, Artificial Sequence
  source: /note="Description of Artificial Sequence: Synthetic oligonucleotide"
agagugccgucugggucuga

SEQ ID NO: 10517 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10518 - DNA, 23 bp, Artificial Sequence
  source: /note="Description of Artificial Sequence: Synthetic primer"
acacagccagaccatatcagcag

SEQ ID NO: 10519 - DNA, 22 bp, Artificial Sequence
  source: /note="Description of Artificial Sequence: Synthetic primer"
aaggcacgcaagggccataacc

SEQ ID NO: 10520 - DNA, 20 bp, Artificial Sequence
  source: /note="Description of Artificial Sequence: Synthetic primer"
gaggcctgtgcagactactc

SEQ ID NO: 10521 - DNA, 22 bp, Artificial Sequence
  source: /note="Description of Artificial Sequence: Synthetic primer"
acagaaatcctatgtggcctgc

SEQ ID NO: 10522 - RNA, 20 nt, Artificial Sequence
  source: /note="Description of Artificial Sequence: Synthetic oligonucleotide"
aacaugagaugcugcugaua

SEQ ID NO: 10523 - DNA, 16 bp, Artificial Sequence
  source: /note="Description of Artificial Sequence: Synthetic oligonucleotide"
cggtcttgtaattgga

SEQ ID NO: 10524 - DNA, 18 bp, Artificial Sequence
  source: /note="Description of Artificial Sequence: Synthetic oligonucleotide"
atggatcggtcttgtaat

SEQ ID NO: 10525 - DNA, 10 bp, Artificial Sequence
  source: /note="Description of Artificial Sequence: Synthetic oligonucleotide"
gaggcagtgg

SEQ ID NO: 10526 - DNA, 12 bp, Artificial Sequence
  source: /note="Description of Artificial Sequence: Synthetic oligonucleotide"
gcagtggtgagg

SEQ ID NO: 10527 - DNA, 29 bp, Artificial Sequence
  source: /note="Description of Artificial Sequence: Synthetic oligonucleotide"
agtacccacttatatggtcatatttcaga

SEQ ID NO: 10528 - DNA, 23 bp, Artificial Sequence
  source: /note="Description of Artificial Sequence: Synthetic oligonucleotide"
taaatgataactggggctatagt

SEQ ID NO: 10529 - DNA, 17 bp, Artificial Sequence
  source: /note="Description of Artificial Sequence: Synthetic oligonucleotide"
cgtaggttctggtttcc

SEQ ID NO: 10530 - DNA, 14 bp, Artificial Sequence
  source: /note="Description of Artificial Sequence: Synthetic oligonucleotide"
gggaaaagtaacaa

SEQ ID NO: 10531 - DNA, 14 bp, Artificial Sequence
  source: /note="Description of Artificial Sequence: Synthetic oligonucleotide"
aaatccttggtgtt

SEQ ID NO: 10532 - DNA, 20 bp, Artificial Sequence
  source: /note="Description of Artificial Sequence: Synthetic oligonucleotide"
ctctcatgataggttggcac

SEQ ID NO: 10533 - DNA, 29 bp, Artificial Sequence
  source: /note="Description of Artificial Sequence: Synthetic oligonucleotide"
tttggcataactagcactctcatgatagg

SEQ ID NO: 10534 - DNA, 15 bp, Artificial Sequence
  source: /note="Description of Artificial Sequence: Synthetic oligonucleotide"
ctagcactctcatga

SEQ ID NO: 10535 - DNA, 17 bp, Artificial Sequence
  source: /note="Description of Artificial Sequence: Synthetic oligonucleotide"
cctgtttttgaagaggc

SEQ ID NO: 10536 - DNA, 13 bp, Artificial Sequence
  source: /note="Description of Artificial Sequence: Synthetic oligonucleotide"
atgtttcattcca

SEQ ID NO: 10537 - DNA, 11 bp, Artificial Sequence
  source: /note="Description of Artificial Sequence: Synthetic oligonucleotide"
gatcaactagg

SEQ ID NO: 10538 - DNA, 10 bp, Artificial Sequence
  source: /note="Description of Artificial Sequence: Synthetic oligonucleotide"
tctggatcaa

SEQ ID NO: 10539 - DNA, 16 bp, Artificial Sequence
  source: /note="Description of Artificial Sequence: Synthetic oligonucleotide"
gtacaaaggaggagag

SEQ ID NO: 10540 - DNA, 11 bp, Artificial Sequence
  source: /note="Description of Artificial Sequence: Synthetic oligonucleotide"
agagtacaaag

SEQ ID NO: 10541 - DNA, 12 bp, Artificial Sequence
  source: /note="Description of Artificial Sequence: Synthetic oligonucleotide"
aggtgtcaggta

SEQ ID NO: 10542 - DNA, 20 bp, Artificial Sequence
  source: /note="Description of Artificial Sequence: Synthetic oligonucleotide"
gaacaagggtcaccacagct

SEQ ID NO: 10543 - DNA, 11 bp, Artificial Sequence
  source: /note="Description of Artificial Sequence: Synthetic oligonucleotide"
caccacagcta

SEQ ID NO: 10544 - DNA, 11 bp, Artificial Sequence
  source: /note="Description of Artificial Sequence: Synthetic oligonucleotide"
atagactcaga

SEQ ID NO: 10545 - DNA, 16 bp, Artificial Sequence
  source: /note="Description of Artificial Sequence: Synthetic oligonucleotide"
gaggcacattagccgt

SEQ ID NO: 10546 - DNA, 11 bp, Artificial Sequence
  source: /note="Description of Artificial Sequence: Synthetic oligonucleotide"
taggttctggt

SEQ ID NO: 10547 - DNA, 17 bp, Artificial Sequence
  source: /note="Description of Artificial Sequence: Synthetic oligonucleotide"
cgtaggttctggtttcc

SEQ ID NO: 10548 - DNA, 16 bp, Artificial Sequence
  source: /note="Description of Artificial Sequence: Synthetic oligonucleotide"
tgctcattattaggag

SEQ ID NO: 10549 - DNA, 21 bp, Artificial Sequence
  source: /note="Description of Artificial Sequence: Synthetic oligonucleotide"
tcattattaggaggctatgct

SEQ ID NO: 10550 - DNA, 16 bp, Artificial Sequence
  source: /note="Description of Artificial Sequence: Synthetic oligonucleotide"
tcattattaggaggct

SEQ ID NO: 10551 - DNA, 21 bp, Artificial Sequence
  source: /note="Description of Artificial Sequence: Synthetic oligonucleotide"
gaagaatttgcctctgataga

SEQ ID NO: 10552 - DNA, 13 bp, Artificial Sequence
  source: /note="Description of Artificial Sequence: Synthetic oligonucleotide"
cctctgatagagc

SEQ ID NO: 10553 - DNA, 18 bp, Artificial Sequence
  source: /note="Description of Artificial Sequence: Synthetic oligonucleotide"
gatagagcatgggttctg

SEQ ID NO: 10554 - DNA, 12 bp, Artificial Sequence
  source: /note="Description of Artificial Sequence: Synthetic oligonucleotide"
ggaggcagtggt

SEQ ID NO: 10555 - DNA, 2000 bp, Artificial Sequence
  source: /note="Description of Artificial Sequence: Synthetic polynucleotide"
  misc_feature (1)..(2000): /note="This sequence may encompass 50-2000 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 10556 - protein, 4 aa, Artificial Sequence
  source: /note="Description of Artificial Sequence: Synthetic peptide"
RGDS

SEQ ID NO: 10557 - DNA, 127 bp, Artificial Sequence
  source: /note="Description of Artificial Sequence: Synthetic polynucleotide"
ccagaccatatcagcagcatctcatgttgaggagcagaacactggaatttagtagcattcggttagagtaatatgttgtctgcaggtttcactggacagcaatattttcatgaatgaattcctgttg

SEQ ID NO: 10558 - DNA, 13 bp, Artificial Sequence
  source: /note="Description of Artificial Sequence: Synthetic oligonucleotide"
aaccggtgcctag

SEQ ID NO: 10559 - DNA, 134 bp, Artificial Sequence
  source: /note="Description of Artificial Sequence: Synthetic polynucleotide"
atgaaaggggaacgcagaagaggcaaaggccacgacggactgtaccagggactcagcaccgccaccaaggacacctatgacgctcttcacatgcaggccctgccgcctcggtaagtcgacgcctcgactgtgcc

SEQ ID NO: 10560 - DNA, 21 bp, Artificial Sequence
  source: /note="Description of Artificial Sequence: Synthetic oligonucleotide"
gaagaagctggtgtgaagttt

SEQ ID NO: 10561 - protein, 30 aa, Artificial Sequence
  source: /note="Description of Artificial Sequence: Synthetic polypeptide"
  MISC_FEATURE (1)..(30): /note="This sequence may encompass 1-6 'Gly Gly Gly Gly Ser' repeating units"
  source: /note="See specification as filed for detailed description of substitutions and preferred embodiments"
GGGGSGGGGSGGGGSGGGGSGGGGSGGGGS

SEQ ID NO: 10562 - RNA, 36 nt, Artificial Sequence; identical to SEQ ID NO: 66
  source: /note="Description of Artificial Sequence: Synthetic oligonucleotide"
  modified_base (1)..(20): a, c, u, g, unknown or other

SEQ ID NO: 10563 - RNA, 100 nt, Artificial Sequence; identical to SEQ ID NO: 69
  source: /note="Description of Artificial Sequence: Synthetic polynucleotide"
  modified_base (1)..(20): a, c, u, g, unknown or other
